US011330776B2

(12) United States Patent
Anand et al.

(10) Patent No.: US 11,330,776 B2
(45) Date of Patent: May 17, 2022

(54) METHODS AND COMPOSITIONS FOR RAPID PLANT TRANSFORMATION

(71) Applicant: PIONEER HI-BRED INTERNATIONAL, INC., Johnston, IA (US)

(72) Inventors: Ajith Anand, West Des Moines, IA (US); Maren L. Arling, Des Moines, IA (US); Alexandre Da Silva Conceicao, Wilmington, DE (US); William James Gordon-Kamm, Urbandale, IA (US); Craig E Hastings, Perry, IA (US); George J Hoerster, Des Moines, IA (US); Todd J Jones, Johnston, IA (US); Theodore Mitchell Klein, Wilmington, DE (US); Carlos M La Rota, Johnston, IA (US); Keith S Lowe, Johnston, IA (US); Shiv Bahadur Tiwari, San Jose, CA (US); Ning Wang, Johnston, IA (US); Xinli Emily Wu, Johnston, IA (US)

(73) Assignee: PIONEER HI-BRED INTERNATIONAL, INC.

( * ) Notice: Subject to any disclaimer, the term of this patent is extended or adjusted under 35 U.S.C. 154(b) by 0 days.

(21) Appl. No.: 15/249,318

(22) Filed: Aug. 26, 2016

(65) Prior Publication Data
US 2017/0121722 A1 May 4, 2017

Related U.S. Application Data

(60) Provisional application No. 62/248,578, filed on Oct. 30, 2015.

(51) Int. Cl.
*A01H 4/00* (2006.01)
*C12N 15/82* (2006.01)
*C07K 14/415* (2006.01)

(52) U.S. Cl.
CPC ......... *A01H 4/008* (2013.01); *C12N 15/8201* (2013.01); *C07K 14/415* (2013.01); *C12N 15/8213* (2013.01); *C12N 15/8216* (2013.01)

(58) Field of Classification Search
CPC ............................. A01H 4/008; C12N 15/8201
See application file for complete search history.

(56) References Cited

U.S. PATENT DOCUMENTS

| 6,153,812 | A | 11/2000 | Fry et al. |
|---|---|---|---|
| 6,512,165 | B1 | 1/2003 | Ross et al. |
| 6,825,397 | B1 | 11/2004 | Lowe et al. |
| 6,838,593 | B2 | 1/2005 | Garnaat et al. |
| 6,995,016 | B2 | 2/2006 | Eudes et al. |
| 7,151,170 | B1 | 12/2006 | Boutilier et al. |
| 7,256,322 | B2 | 8/2007 | Lowe et al. |
| 7,268,271 | B2 | 9/2007 | Lowe et al. |
| 7,579,529 | B2* | 8/2009 | Gordon-Kamm ........ A01H 1/08 800/320.1 |
| 7,598,430 | B2 | 10/2009 | Weeks et al. |
| 7,700,829 | B2 | 4/2010 | Zuo et al. |
| 8,124,411 | B2 | 2/2012 | Skula et al. |
| 8,395,020 | B2* | 3/2013 | Rout .................. C12N 15/8201 800/278 |
| 8,853,488 | B2 | 10/2014 | Rout et al. |
| 2003/0082813 | A1* | 5/2003 | Zuo ...................... C12N 15/821 435/468 |
| 2012/0192308 | A1 | 7/2012 | Heidmann et al. |
| 2014/0157453 | A1 | 6/2014 | Gordon-Kamm et al. |
| 2014/0237681 | A1* | 8/2014 | Gordon-Kamm .... C07K 14/415 800/278 |

FOREIGN PATENT DOCUMENTS

| WO | 2013/033308 A2 | 3/2013 |
|---|---|---|
| WO | 2003/029408 A2 | 4/2013 |
| WO | 2014/143304 A1 | 9/2014 |

OTHER PUBLICATIONS

Graaff et al (The WUS homeobox-containing (WOX) protein family. Genome Biology 10:248, 2009).*
Magnani et al (From Endonucleases to Transcription Factors: Evolution of the AP2 DNA Binding Domain in Plants. The Plant Cell, vol. 16, 2265-2277, Sep. 2004).*
And Ikeuchi et al (Plant Callus: Mechanisms of Induction and Repression. The Plant Cell, vol. 25: 3159-3173, Sep. 2013).*
Smertenko et al (Somatic embryogenesis: life and death processes during apical-basal patterning. Journal of Experimental Botany, vol. 65, No. 5, pp. 1343-1360, 2014).*
Boutilier et al (Ectopic Expression of Baby Boom Triggers a Conversion from Vegetative to Embryonic Growth. The Plant Cell, vol. 14, 1737-1749, 2002).*
Ernst et al (Effect of exogenous cytokinins on growth and somatic embryogenesis in anise cells (*Pimpinella anisum* L.). Planta. 161: 246-8, 1984).*
C. L. Armstrong et al., Establishment and maintenance of friable, embryogenic maize callus and the involvement of L-proline, Planta, 1985, pp. 207-214, vol. 164.

(Continued)

*Primary Examiner* — Bratislav Stankovic
*Assistant Examiner* — Wayne Zhong

(57) ABSTRACT

The disclosure pertains to methods and compositions for the rapid and efficient transformation of plants. The disclosure further provides methods for producing a transgenic plant, comprising (a) transforming a cell of an explant with an expression construct comprising (i) a nucleotide sequence encoding a WUS/WOX homeobox polypeptide; (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and (c) germinating the regenerable plant structure to form the transgenic plant. This abstract is intended as a scanning tool for purposes of searching in the particular art and is not intended to be limiting of the present disclosure.

29 Claims, 17 Drawing Sheets
(2 of 17 Drawing Sheet(s) Filed in Color)
Specification includes a Sequence Listing.

(56) References Cited

OTHER PUBLICATIONS

A. Arroyo-Herrera et al., Expression of Wuschel in Coffea canephora causes ectopic morphogenesis and increases somatic embryogenesis, Plant Cell Tiss Organ Cult, 2008, pp. 171-180, vol. 94.
Shyamala Bhaskaran et al., Regeneration in Cereal Tissue Culture: A Review, Crop Science, 1990. pp. 1328-1336, vol. 30.
O. Bouchabke-Coussa et al., Wuschel overexpression promotes somatic embryogenesis and induces organogenesis in cotton (Gossypium hirsutum L.) tissues cultured in vitro, Plant Cell Rep., 2013, pp. 675-686, vol. 32.
Kim Boutilier et al., Ectopic Expression of Baby Boom Triggers a Conversion from Vegetative to Embryonic Growth, The Plant Cell, pp. 1737-1749, vol. 14.
Myeong-Je Cho et al., Transformation of recalcitrant barley cultivars through improvement of regenerability and decreased albinism, Plant Science, 1998, pp. 229-244, vol. 138.
M.-J. Cho et al., Stable transformation of rice (Oryza sativa L.) via microprojectile bombardment of highly regenerative, green tissues derived from mature seed, Plant Cell Rep, 2004, pp. 483-489, vol. 22.
B. V. Conger et al., Direct Embryogenesis from Mesophyll Cells of Orchardgrass, Science, Aug. 26, 1983, pp. 850-851, vol. 221 (4613).
Wei Deng et al., A novel method for induction of plant regeneration via somatic embryogenesis, Plant Science, 2009, pp. 43-48, vol. 177.
Souad El Ouakfaoui et al., Control of somatic embryogenesis and embryo development by AP2 transcription factors, Plant Mol Biol 2010, pp. 313-326, vol. 74.
Sergio L. Florez et al., Enhanced somatic embryogenesis in Theobroma cacao using homologous Baby Boom transcription factor, BMC Plant Biology, 2015, 15:121.
Sean P. Gordon et al., Pattern formation during de novo assembly of the Arabidopsis shoot meristem, Development, 2007, pp. 3539-3548, vol. 134.
Iris Heidmann et al., Efficient sweet pepper transformation mediated by the Baby Boom transcription factor, Plant Cell Rep, 2011, pp. 1107-1115, vol. 30.
Noriko Kamiya et al., Isolation and characterization of a rice Wuschel-type homeobox gene that is specifically expressed in the central cells of a quiescent center in the root apical meristem, The Plant Journal, 2003, pp. 429-441, vol. 35.

F. Morcillo et al., EgAP2-1, an Ainteguments-like (AIL) gene expressed in meristematic and proliferating tissues of embryos in oil palm, Planta, 2007, pp. 1353-1362, vol. 226.
Andreas P. Mordhorst et al., Plant Embryogenesis, Critical Reviews in Plant Sciences, 1997, pp. 535-576, vol. 16:6.
Folke Skoog et al., Chemical Regulation of Growth and Organ Formation in Plant Tissues Cultured In Vitro, Symposia of the Society for Experimental Biology, 1957, pp. 118-131.
L. Y. Solis-Ramos et al., Overexpression of Wuschel in C. chinense causes ectopic morphogenesis, Plant Cell Tiss Organ Cult, 2009, pp. 279-287, vol. 96.
Munetaka Sugiyama, Genetic Analysis of Plant Morphogenesis in Vitro, International Review of Cytology, 2000, pp. 67-84, vol. 196.
Heng Zhong et al., In-Vitro morphogenesis of corn (Zea mays L.), Planta, 1992, pp. 483-489, vol. 187.
Heng Zhong et al., In-Vitro morphogenesis of corn (Zea mays L.), Planta, 1992, pp. 490-497, vol. 187.
J. Lynn Zimmerman, Somatic Embryogenesis: A Model for Early Development in Higher Plants, The Plant Cell, Oct. 1993, pp. 1411-1423, vol. 5.
Jianru Zuo et al., The Wuschel gene promotes vegetative-to-embryonic transition in Arabidopsis, The Plant Journal, pp. 2002, pp. 349-359, vol. 30(3).
U.S. Appl. No. 15/249,252, filed Aug. 26, 2016.
PCT Application No. PCT/US16/49135—filed Aug. 26, 2016.
PCT Application No. PCT/US16/49132—filed Aug. 26, 2016.
PCT Application No. PCT/US16/49128—filed Aug. 26, 2016.
Keith Lowe et al., Morphogenic Regulators Baby boom and Wuschel Improve Monocot Transformation, The Plant Cell, Sep. 2016, pp. 1998-2015, vol. 28.
Kerry A. Lutz et al., Steroid-inducible Baby Boom system for development of fertile Arabidopsis thaliana plants after prolonged tissue culture, Plant Cell Rep, 2015, pp. 1849-1856, vol. 34.
International Search Report and Written Opinion—PCT/US2016/049144—dated Nov. 30, 2016.
van der Graaff, E. et al., "The WUS homeobox-containing (WOX) protein family" Genome Biol 10, 248 (2009). https://doi.orq/10.1186/qb-2009-10-12-248.
Feng, K. et al., "Advances in AP2/ERF super-family transcription factors in plant" Critical Review in Biotechnology, vol. 40, Issue 6, pp. 750-776, 2020; https://doi.orq/10.1080/07388551.2020.1768509.

* cited by examiner

METHODS AND COMPOSITIONS FOR RAPID PLANT TRANSFORMATION

FIELD OF THE DISCLOSURE

The present disclosure relates generally to the field of plant molecular biology, including genetic manipulation of plants. More specifically, the present disclosure pertains to rapid, high efficiency methods and compositions for producing a transformed plant in the absence of cytokinin and without callus formation.

CROSS-REFERENCE TO RELATED APPLICATIONS

This application claims priority to U.S. Provisional Application No. 62/248,578, filed Oct. 30, 2015, which is hereby incorporated herein in its entirety by reference.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 20160826_6752USNP_SeqList.txt, created on Aug. 17, 2016, and having a size of 1000 KB and is filed concurrently with the specification. The sequence listing contained in this ASCII formatted document is part of the specification and is herein incorporated by reference in its entirety.

BACKGROUND

Major advances in plant transformation have occurred over the last several years. Transformation of a variety of agronomically important plants, e.g., maize, soybean, canola, wheat, indica rice, sugarcane and sorghum, and inbred lines continues to be both difficult and time consuming. Traditionally, the only way to elicit a culture response has been by optimizing media components and/or explant material and source. This has led to success in some genotypes, but many important crop plants, including elite inbreds or varieties, fail to produce a favorable culture response. Although transformation of model genotypes can be efficient, the process of introgressing transgenes into production inbreds is laborious, expensive and time consuming. It would save considerable time and money if genes could be introduced into and evaluated with greater speed and efficiency.

Despite limitations, *Agrobacterium*-mediated transformation of monocots such as corn, rice, and wheat remains a widely used experimental approach, often with the use of meristematic tissue such as immature embryos as the explants of choice (e.g., Ishida et al., 1996; Zhao et al., 2001; Frame et al., 2002). For rice, transformation of imbibed seeds has also been reported (Toki et al., 2006). To date, the most common methods used for contacting cells with *Agrobacterium* include: culturing explant tissue such as immature embryos ("co-culture"), possibly including a "delay" or "resting" (non-selective) step, followed by culturing on selection medium containing auxin(s) allowing dedifferentiation of cells to form callus. During this callusing phase, transformed resistant callus tissue is selected in the presence of an appropriate selection agent on a selection medium. This is followed by growth of cells under conditions that promote differentiation of the callus and regeneration of the callus into plants on regeneration and rooting media. This process has typically required at least 10-12 weeks to produce plants that can be transferred to soil for further growth. The process also requires several manual transfers of tissue throughout the transformation process and uses several different types of media.

Thus the use of standard transformation and regeneration protocols is time consuming and inefficient, and negatively impacts transgenic product development timelines, given that there is usually a seasonally limited "priority development window" for making decisions regarding which genetic constructs to prioritize for use in larger scale field work based on results obtained during initial research. The available standard methods of transformation and regeneration have multiple drawbacks that limit the speed and efficiency with which transgenic plants can be produced and screened. For example, many standard methods of transformation and regeneration require the use of high auxin or cytokinin levels and require steps involving either embryogenic callus formation or organogenesis, leading to procedures that take many weeks before producing plants for growth in a greenhouse setting following transformation. It has been reported (Zhong et al. (1992) Planta 187:490-497) that such methods can take 12-23 weeks to produce plants, which include the steps of supplying 2,4-D to stimulate somatic embryo formation in corn (taking up to 8 weeks), production of embryogenic callus from the primary somatic embryos (taking up to an additional 8 weeks), forming shoots (taking up to an additional 3 weeks), and finally rooting (taking up to an additional 1 to 3 weeks). Alternatively, Zhong et al. immediately supplies a cytokinin along with the auxin to stimulate direct morphogenesis to produce shoots and direct plant formation from 8 to 28 weeks (Zhong et al. (1992) Planta 187:490-497).

Despite advances in plant molecular biology, particularly plant transformation and regeneration methods there remains a need for a high throughput system to produce transgenic plants quickly and efficiently to provide more time and flexibility for making research and product development decisions. Such a high throughput system for transformation facilitates production of large numbers of transgenic plants for gene testing and/or product development while lowering material and labor costs.

SUMMARY

The present disclosure comprises methods and compositions for the rapid and efficient transformation of plants, e.g., monocot plants such as maize. In various aspects, the present disclosure further provides methods for producing a transgenic plant, comprising: (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and (c) germinating the regenerable plant structure to form the transgenic plant. In an aspect, the regenerable plant structure is produced within about 0 to about 7 days or within about 0 to about 14 days of transforming the cell. In an aspect, germinating comprises transferring the regenerable plant structure to a maturation medium comprising an exogenous cytokinin and forming the transgenic plant. In an aspect, the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153. In an aspect, the nucleotide sequence encoding a site-specific recombinase is operably linked to a constitutive promoter, an inducible promoter, or a developmentally regulated promoter. In an aspect, (c) germinating is performed in the presence of exogenous cytokinin. In an aspect, the nucleotide sequence encoding the WUS/WOX homeobox polypeptide and/or the nucleotide sequence encoding a polypeptide comprising two AP2-DNA binding domains is operably linked to a promoter selected from an inducible promoter, a developmentally regulated promoter, or a constitutive promoter. In an aspect, the constitutive promoter operably linked to the nucleotide sequence encoding the WUS/WOX homeobox polypeptide and/or the nucleotide sequence encoding a polypeptide comprising two AP2-DNA binding domains is selected from UBI, LLDAV, EVCV, DMMV, BSV(AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2); the inducible promoter operably linked to the nucleotide sequence encoding the WUS/WOX homeobox polypeptide and/or the nucleotide sequence encoding a polypeptide comprising two AP2-DNA binding domains is selected from AXIG1, DR5, XVE, GLB1, OLE, LTP2, HSP17.7, HSP26, HSP18A, or promoters activated by tetracycline, ethamethsulfuron or chlorsulfuron; and the developmentally regulated promoter operably linked to the nucleotide sequence encoding the WUS/WOX homeobox polypeptide and/or the nucleotide sequence encoding a polypeptide comprising two AP2-DNA binding domains is selected from PLTP, PLTP1, PLTP2, PLTP3, SDR, LGL, LEA-14A, or LEA-D34. In an aspect, the explant is derived from a monocot or a dicot. In an aspect, a seed from the plant produced by the method.

In various aspects, the present disclosure further provides methods for producing a transgenic plant, comprising: (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of a polypeptide of (a) in each transformed cell to form a regenerable plant structure in the absence of exogenous cytokinin, wherein no callus is formed; and; (c) germinating the regenerable plant structure to form the transgenic plant; wherein the WUS/WOX homeobox polypeptide comprises the amino acid sequence of any of SEQ ID NO: 4, 6, 8, 10, 12, 14, or 16; or wherein the WUS/WOX homeobox polypeptide is encoded by the nucleotide sequence of any of SEQ ID NO: 3, 5, 7, 9, 11, 13, or 15; and wherein the polypeptide comprising two AP2-DNA binding domains comprises the amino acid sequence of any of SEQ ID NO: 18, 20, 63, 65, or 67; or wherein the polypeptide comprising two AP2-DNA binding domains is encoded by the nucleotide sequence of any of SEQ ID NO: 17, 19, 21, 62, 64, 66, or 68. In an aspect, the regenerable plant structure is produced within about 0 to about 7 days or within about 0 to about 14 days of transforming the cell. In an aspect, germinating comprises transferring the regenerable plant structure to a maturation medium comprising an exogenous cytokinin and forming the transgenic plant. In an aspect, the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153. In an aspect, the nucleotide sequence encoding a site-specific recombinase is operably linked to a constitutive promoter, an inducible promoter, or a developmentally regulated promoter. In an aspect, (c) germinating is performed in the presence of exogenous cytokinin. In an aspect, the nucleotide sequence encoding the WUS/WOX homeobox polypeptide and/or the nucleotide sequence encoding a polypeptide comprising two AP2-DNA binding domains is operably linked to a promoter selected from an inducible promoter, a developmentally regulated promoter, or a constitutive promoter. In an aspect, the constitutive promoter operably linked to the nucleotide sequence encoding the WUS/WOX homeobox polypeptide and/or the nucleotide sequence encoding a polypeptide comprising two AP2-DNA binding domains is selected from UBI, LLDAV, EVCV, DMMV, BSV(AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2); the inducible promoter operably linked to the nucleotide sequence encoding the WUS/WOX homeobox polypeptide and/or the nucleotide sequence encoding a polypeptide comprising two AP2-DNA binding domains is selected from AXIG1, DR5, XVE, GLB1, OLE, LTP2, HSP17.7, HSP26, HSP18A, or promoters activated by tetracycline, ethamethsulfuron or chlorsulfuron; and the developmentally regulated promoter operably linked to the nucleotide sequence encoding the WUS/WOX homeobox polypeptide and/or the nucleotide sequence encoding a polypeptide comprising two AP2-DNA binding domains is selected from PLTP, PLTP1, PLTP2, PLTP3, SDR, LGL, LEA-14A, or LEA-D34. In an aspect, the explant is derived from a monocot or a dicot. In an aspect, a seed from the plant produced by the method.

In various aspects, the present disclosure further provides methods for producing a transgenic plant, comprising: (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); (b) allowing expression of the polypeptide of (a) in each transformed cell to form a regenerable plant structure in the absence of exogenous cytokinin, wherein no callus is formed; and (c) germinating the regenerable plant structure of (b) for about 14 to about 60 days to form a plantlet; and (d)

allowing the plantlet of (c) to grow into a plant. In an aspect, the regenerable plant structure is produced within about 0 to about 7 days or within about 0 to about 14 days of transforming the cell. In an aspect, germinating comprises transferring the regenerable plant structure to a maturation medium comprising an exogenous cytokinin and forming the transgenic plant. In an aspect, the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153. In an aspect, the nucleotide sequence encoding a site-specific recombinase is operably linked to a constitutive promoter, an inducible promoter, or a developmentally regulated promoter. In an aspect, (c) germinating is performed in the presence of exogenous cytokinin. In an aspect, the nucleotide sequence encoding the WUS/WOX homeobox polypeptide and/or the nucleotide sequence encoding a polypeptide comprising two AP2-DNA binding domains is operably linked to a promoter selected from an inducible promoter, a developmentally regulated promoter, or a constitutive promoter. In an aspect, the constitutive promoter operably linked to the nucleotide sequence encoding the WUS/WOX homeobox polypeptide and/or the nucleotide sequence encoding a polypeptide comprising two AP2-DNA binding domains is selected from UBI, LLDAV, EVCV, DMMV, BSV(AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2); the inducible promoter operably linked to the nucleotide sequence encoding the WUS/WOX homeobox polypeptide and/or the nucleotide sequence encoding a polypeptide comprising two AP2-DNA binding domains is selected from AXIG1, DR5, XVE, GLB1, OLE, LTP2, HSP17.7, HSP26, HSP18A, or promoters activated by tetracycline, ethamethsulfuron or chlorsulfuron; and the developmentally regulated promoter operably linked to the nucleotide sequence encoding the WUS/WOX homeobox polypeptide and/or the nucleotide sequence encoding a polypeptide comprising two AP2-DNA binding domains is selected from PLTP, PLTP1, PLTP2, PLTP3, SDR, LGL, LEA-14A, or LEA-D34. In an aspect, the explant is derived from a monocot or a dicot. In an aspect, a seed from the plant produced by the method.

In various aspects, the present disclosure further provides methods for producing a transgenic plant, comprising (a) transforming one or more cells of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and germinating the regenerable plant structure to form the transgenic plant. In an aspect, the present disclosure further provides methods for producing a plantlet obtained from a regenerable plant structure prepared using the disclosed methods. In an aspect, the present disclosure further provides methods for producing a plant obtained from the regenerable plant structure. In various aspects, germinating is performed in the presence of exogenous cytokinin. In an aspect, the present disclosure further provides kits comprising (a) an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) instructions for obtaining a plant regenerable structure in the absence of exogenous cytokinin, wherein no callus is formed; and (c) instructions for germinating the regenerable plant structure to form a transgenic plant.

The present disclosure comprises methods and compositions for the rapid and efficient transformation of plants, e.g., monocot plants such as maize. In various aspects, the present disclosure provides methods for producing a transgenic plant, comprising (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and (c) germinating the regenerable plant structure to form the transgenic plant. In various aspects, the regenerable plant structure is produced within about 0-7 days or about 0-14 days of transforming the cell. In various aspects, germinating comprises transferring the regenerable plant structure to a maturation medium comprising an exogenous cytokinin and forming the transgenic plant. In various aspects, germinating is performed in the presence of exogenous cytokinin. In various aspects, the expression construct further comprises a nucleotide sequence encoding a site-specific recombinase selected from of FLP, Cre, SSV1, lambda Int, phi C31 Int, HK022, R, Gin, Tn1721, CinH, ParA, Tn5053, Bxb1, TP907-1, or U153. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, HSP18A or XVE. In various aspects, the nucleotide sequence encoding the WUS/WOX homeobox polypeptide is operably linked to a promoter selected from an inducible promoter, a developmentally regulated promoter, or a constitutive promoter. In various aspects, the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2); the inducible promoter is selected from GLB1, OLE, LTP2, AXIG1 DR5, HSP17.7, HSP26, HSP18A, or XVE; and the developmentally regulated promoter is selected from PLTP, PLTP1, PLTP2, PLTP3, LGL, LEA-14A, or LEA-D34. In various aspects, the explant is derived from a monocot or a dicot. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination thereof; and (b) allowing expression of a polypeptide of (a) in each transformed cell to form a regenerable plant structure in the absence of exogenous cytokinin, wherein no callus is formed; and; (c)

germinating the regenerable plant structure to form the transgenic plant; wherein the WUS/WOX homeobox polypeptide comprises the amino acid sequence of any one of SEQ ID NO: 4, 6, 8, 10, 12, 14, or 16; or wherein the WUS/WOX homeobox polypeptide is encoded by the nucleotide sequence of any one of SEQ ID NO: 3, 5, 7, 9, 11, 13, or 15; and wherein the polypeptide comprising two AP2-DNA binding domains comprises the amino acid sequence of any one of SEQ ID NO: 18, 20, 63, 65, or 67; or wherein the polypeptide comprising two AP2-DNA binding domains is encoded by the nucleotide sequence of any one of SEQ ID NO: 17, 19, 21, 62, 64, 66, or 68. In various aspects, the regenerable plant structure is produced within about 0-7 days or about 0-14 days of transforming the cell. In various aspects, germinating comprises transferring the regenerable plant structure to a maturation medium comprising an exogenous cytokinin and forming the transgenic plant. In various aspects, germinating is performed in the presence of exogenous cytokinin. In various aspects, the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153. In various aspects, the nucleotide sequence encoding a site-specific recombinase is operably linked to a constitutive promoter, an inducible promoter, or a developmentally regulated promoter. In various aspects, the inducible promoter is GLB1, OLE, LTP2, HSP17.7, HSP26, HSP18A or XVE. In various aspects, the nucleotide sequence encoding the WUS/WOX homeobox polypeptide is operably linked to a promoter selected from an inducible promoter, a developmentally regulated promoter, or a constitutive promoter. In various aspects, the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2); the inducible promoter is selected from GLB1, OLE, LTP2, AXIG1 DR5, HSP17.7, HSP26, HSP18A or XVE; and the developmentally regulated promoter is selected from PLTP, PLTP1, PLTP2, PLTP3, LGL, LEA-14A, or LEA-D34. In various aspects, the explant is derived from a monocot or a dicot. In various aspects, a seed from the plant produced by the method is provided.

In a further aspect, the present disclosure provides methods for producing a transgenic plant comprising: (a) transforming a cell of an explant with an expression construct comprising (i) a nucleotide sequence encoding a WUS/WOX homeobox polypeptide; (ii) a nucleotide sequence encoding a polypeptide comprising two AP2-DNA binding domains; or (iii) a combination of (i) and (ii); (b) allowing expression of the polypeptide of (a) in each transformed cell to form a regenerable plant structure in the absence of exogenous cytokinin, wherein no callus is formed; and (c) allowing the regenerable plant structure of (b) to mature into a plantlet for about 14 to about 60 days; and (d) allowing the plantlet of (c) to grow into a plant. In various aspects, the regenerable plant structure is produced within about 0-7 days or about 0-14 days of transforming the cell. In various aspects, germinating comprises transferring the regenerable plant structure to a maturation medium comprising an exogenous cytokinin and forming the transgenic plant. In various aspects, germinating is performed in the presence of exogenous cytokinin. In various aspects, the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, HSP18A or XVE. In various aspects, the nucleotide sequence encoding the WUS/WOX homeobox polypeptide is operably linked to a promoter selected from an inducible promoter, a developmentally regulated promoter, and a constitutive promoter. In various aspects, the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, and ZM-ADF PRO (ALT2); the inducible promoter is selected from GLB1, OLE, LTP2, AXIG1 DR5, HSP17.7, HSP26, HSP18A, or XVE; and the developmentally regulated promoter is selected from PLTP, PLTP1, PLTP2, PLTP3, LGL, LEA-14A, or LEA-D34. In various aspects, the explant is derived from a monocot or a dicot. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and (c) germinating the regenerable plant structure to form the transgenic plant. In various aspects, the expression construct comprises both the nucleotide sequence encoding the WUS/WOX homeobox polypeptide and the nucleotide sequence encoding the polypeptide comprising two AP2-DNA binding domains. In various aspects, the expression construct comprises the nucleotide sequence encoding the WUS/WOX homeobox polypeptide. In various aspects, the expression construct comprises the nucleotide sequence encoding the polypeptide comprising two AP2-DNA binding domains. In various aspects, the expression of the nucleotide sequence encoding the WUS/WOX homeobox polypeptide and/or the nucleotide sequence encoding the polypeptide comprising two AP2 binding domains occurs less than 1 day, less than 2 days, less than 5 days, less than 7 days, or less than about 14 days after initiation of transformation. In various aspects, germinating is performed in the presence of exogenous cytokinin. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the WUS/WOX homeobox polypeptide is a WUS1, WUS2, WUS3, WOX2A, WOX4, WOX5, or WOX9 polypeptide. In various aspects, the nucleotide sequence encoding the WUS/WOX homeobox polypeptide is a monocot nucleotide. In various aspects, the monocot is barley, maize, millet, oats, rice, rye, *Setaria* sp., sorghum, sugarcane, switchgrass, triticale, turfgrass, or wheat. In various aspects, the nucleotide sequence encoding the WUS/WOX homeobox polypeptide is a dicot nucleotide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the nucleotide sequence encoding a WUS/WOX homeobox polypeptide encodes an amino acid sequence comprising any one of SEQ ID NOs:4, 6, 8, 10, 12, 14, or 16. In various aspects, the nucleotide sequence encoding a WUS/WOX homeobox polypeptide comprises any one of SEQ ID NOs:3, 5, 7, 9, 11, 13, or 15. In various aspects, the WUS/WOX homeobox polypeptide is a WUS1 polypeptide. In various aspects, the WUS1 polypeptide is a maize, sorghum, rice or *Setaria* sp. WUS1 polypeptide. In various aspects, the WUS1 polypeptide is a maize or rice WUS1 polypeptide. In various aspects, the WUS1 polypeptide is a maize WUS1 polypeptide. In various aspects, the WUS1 polypeptide comprises an amino acid sequence of SEQ ID NO: 4. In various aspects, the WUS1 polypeptide is encoded by a nucleotide sequence comprising SEQ ID NO: 3. In various aspects, the WUS/WOX homeobox polypeptide is a WUS2 polypeptide. In various aspects, the WUS2 polypeptide is a maize, sorghum, rice or *Setaria* sp. WUS2 polypeptide. In various aspects, the WUS2 polypeptide is a maize or rice WUS2 polypeptide. In various aspects, the WUS2 polypeptide is a maize WUS2 polypeptide. In various aspects, the WUS2 polypeptide comprises the amino acid sequence SEQ ID NO:6. In various aspects, the WUS2 polypeptide is encoded by a nucleotide sequence comprising SEQ ID NO: 5. In various aspects, the WUS/WOX homeobox polypeptide is a WUS3 polypeptide. In various aspects, the WUS3 polypeptide is a maize, sorghum, rice or *Setaria* WUS3 polypeptide. In various aspects, the WUS3 polypeptide is a maize or rice WUS3 polypeptide. In various aspects, the WUS3 polypeptide is a maize WUS3 polypeptide. In various aspects, the WUS3 polypeptide comprises the amino sequence of SEQ ID NO:8. In various aspects, the WUS3 polypeptide is encoded by a nucleotide sequence comprising SEQ ID NO:7. In various aspects, the WUS/WOX homeobox polypeptide is a WOX5 polypeptide. In various aspects, the WOX5 polypeptide is a WOX5A polypeptide. In various aspects, the WOX5 polypeptide is a maize, sorghum, rice or *Setaria* WOX5 polypeptide. In various aspects, the WOX5 polypeptide is a maize or rice WOX5 polypeptide. In various aspects, the WOX5 polypeptide is a maize WOX5 polypeptide. In various aspects, the WOX5 polypeptide comprises the amino acid sequence of SEQ ID NO: 14. In various aspects, the WOX5 polypeptide is encoded by a nucleotide sequence comprising SEQ ID NO: 13. In various aspects, the polypeptide comprising the two AP2-DNA binding domains is an ODP2, BBM2, BMN2, or BMN3 polypeptide. In various aspects, the polypeptide comprising the two AP2-DNA binding domains is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize or rice. In various aspects, the monocot is maize. In various aspects, the polypeptide comprising the two AP2-DNA binding domains is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the polypeptide comprising the two AP2-DNA binding domains comprises an amino acid sequence of any one of SEQ ID NO: 18, 20, 63, 65, or 67. In various aspects, the polypeptide comprising the two AP2-DNA binding domains is encoded by a nucleotide sequence comprising any one of SEQ ID NO: 17, 19, 21, 62, 64, 66, or 68. In various aspects, the polypeptide comprising the two AP2-DNA binding domains is an ODP2 polypeptide. In various aspects, the ODP2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, rice, or *Setaria* sp. In various aspects, the monocot is maize or rice. In various aspects, the ODP2 is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the ODP2 polypeptide comprises the amino acid sequence of any one of SEQ ID NO: 18, 63, 65, or 67. In various aspects, the ODP2 polypeptide is encoded by a nucleotide sequence comprising the sequence of any one of SEQ ID NO: 17, 21, 62, 64, 66, or 68. In various aspects, the polypeptide comprising the two AP2-DNA binding domains is a BBM2 polypeptide. In various aspects, the BBM2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sugarcane, rice, or *Setaria* sp. In various aspects, the monocot is maize or rice. In various aspects, the monocot is maize. In various aspects, the BBM2 polypeptide is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the BBM2 polypeptide comprises the amino acid sequence of SEQ ID NO: 20. In various aspects, the BBM2 polypeptide is encoded by a nucleotide sequence comprising the sequence of SEQ ID NO: 19. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the regenerable plant structure is formed within about 0 to about 7 days of transforming the cell or within about 0 to about 14 days of transforming the cell and the transgenic plant is formed in about 14 days of transforming the cell to about 60 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination thereof; (b) allowing expression of a polypeptide of (a) in each transformed cell to form a regenerable plant structure in the absence of exogenous cytokinin, wherein no callus is formed; and (c) germinating the regenerable plant structure to form the transgenic plant; wherein the WUS/WOX homeobox polypeptide comprises the amino acid sequence of any one of SEQ ID NO: 4, 6, 8, 10, 12, 14, or 16; or wherein the WUS/WOX homeobox polypeptide is encoded by the nucleotide sequence of any one of SEQ ID NO: 3, 5, 7, 9, 11, 13, or 15; and wherein the polypeptide comprising two AP2-DNA binding domains comprises the amino acid sequence of any one of SEQ ID NO: 18, 20, 63, 65, or 67; or wherein the polypeptide comprising two AP2-DNA binding domains is encoded by the nucleotide sequence of any one of SEQ ID NO: 17, 19, 21, 62, 64, 66, or 68. In various aspects, the expression construct comprises both the nucleotide sequence encoding the WUS/WOX homeobox polypeptide and the nucleotide sequence encoding the polypeptide comprising two AP2-DNA binding domains. In various aspects, the expression construct comprises the nucleotide sequence encoding the WUS/WOX homeobox polypeptide. In various aspects, the expression construct comprises the nucleotide sequence encoding the polypeptide comprising two AP2-DNA binding domains. In various aspects, the expression of the nucleotide sequence encoding the WUS/WOX homeobox polypeptide and/or the nucleotide sequence encoding the polypeptide comprising two AP2 binding domains occurs less than 1 day, less than 2 days, less than 5 days, less than 7 days, or less than about 14 days after initiation of transformation. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the WUS/WOX homeobox polypeptide is SEQ ID NO: 4. In various aspects, the WUS/WOX homeobox polypeptide is encoded by SEQ ID NO: 3. In various aspects, the WUS/WOX homeobox polypeptide is SEQ ID NO:6. In various aspects, the WUS/WOX homeobox polypeptide is encoded by SEQ ID NO: 5. In various aspects, the WUS/WOX homeobox polypeptide is SEQ ID NO:8. In various aspects, the WUS/WOX homeobox polypeptide is encoded by SEQ ID NO:7. In various aspects, the WUS/WOX homeobox polypeptide is SEQ ID NO: 14. In various aspects, the WUS/WOX homeobox polypeptide is encoded by SEQ ID NO: 13. In various aspects, the polypeptide comprising two AP2-DNA binding domains is SEQ ID NO: 20. In various aspects, the polypeptide comprising two AP2-DNA binding domains is encoded by SEQ ID NO: 19. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the regenerable plant structure is formed within about 0 to about 7 days of transforming the cell or within about 0 to about 14 days of transforming the cell and the transgenic plant is formed in about 14 days of transforming the cell to about 60 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS2 polypeptide; or (ii) a nucleotide sequence encoding an ODP2 polypeptide; or (iii) a combination thereof; (b) allowing expression of a polypeptide of (a) in each transformed cell to form a regenerable plant structure in the absence of exogenous cytokinin, wherein no callus is formed; and (c) germinating the regenerable plant structure to form the transgenic plant; wherein the WUS2 polypeptide comprises the amino acid sequence of SEQ ID NO: 4; or wherein the WUS2 polypeptide is encoded by the nucleotide sequence of SEQ ID NO: 3; and wherein the ODP2 polypeptide comprises the amino acid sequence of SEQ ID NO: 18; or wherein the polypeptide comprising two AP2-DNA binding domains is encoded by the nucleotide sequence of any one of SEQ ID NO: 17 or 21. In various aspects, the expression construct comprises both the nucleotide sequence encoding the WUS/WOX homeobox polypeptide and the nucleotide sequence encoding the polypeptide comprising two AP2-DNA binding domains. In various aspects, the expression construct comprises the nucleotide sequence encoding the WUS/WOX homeobox polypeptide. In various aspects, the expression construct comprises the nucleotide sequence encoding the polypeptide comprising two AP2-DNA binding domains. In various aspects, the expression of the nucleotide sequence encoding the WUS/WOX homeobox polypeptide and/or the nucleotide sequence encoding the polypeptide comprising two AP2 binding domains occurs less than 1 day, less than 2 days, less than 5 days, less than 7 days, or less than about 14 days after initiation of transformation. In various aspects, germinating is performed in the presence of exogenous cytokinin. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the regenerable plant structure is formed within about 0 to about 7 days of transforming the cell or within about 0 to about 14 days of transforming the cell and the transgenic plant is formed in about 14 days of transforming the cell to about 60 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; and (b) allowing expression of the polypeptide of (a) in each transformed cell to form a regenerable plant structure in the absence of exogenous cytokinin, wherein no callus is formed; and (c) germinating the regenerable plant structure to form the transgenic plant. In various aspects, the expression of the nucleotide sequence encoding the WUS/WOX homeobox polypeptide occurs less than 1 day, less than 2 days, less than 5 days, less than 7 days, or less than about 14 days after initiation of transformation. In various aspects, germinating is performed in the presence of exogenous cytokinin. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the WUS/WOX homeobox polypeptide is a WUS1, WUS2, WUS3, WOX2A, WOX4, WOX5, or WOX9 polypeptide. In various aspects, the nucleotide sequence encoding the WUS/WOX homeobox polypeptide is a monocot nucleotide. In various aspects, the monocot is barley, maize, millet, oats, rice, rye, *Setaria* sp., sorghum, sugarcane, switchgrass, triticale, turfgrass, or wheat. In various aspects, the nucleotide sequence encoding the WUS/WOX homeobox polypeptide is a dicot nucleotide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the nucleotide sequence encoding a WUS/WOX homeobox polypeptide encodes an amino acid sequence comprising any one of SEQ ID NOs:4, 6, 8, 10, 12, 14, or 16. In various aspects, the nucleotide sequence encoding a WUS/WOX homeobox polypeptide comprises any one of SEQ ID NOs:3, 5, 7, 9, 11, 13, or 15. In various aspects, the WUS/WOX homeobox polypeptide is a WUS1 polypeptide. In various aspects, the WUS1 polypeptide is a maize, sorghum, rice or *Setaria* sp. WUS1 polypeptide. In various aspects, the WUS1 polypeptide is a maize or rice WUS1 polypeptide. In various aspects, the WUS1 polypeptide is a maize WUS1 polypeptide. In various aspects, the WUS1 polypeptide comprises an amino acid sequence of SEQ ID NO: 4. In various aspects, the WUS1 polypeptide is encoded by a nucleotide sequence comprising SEQ ID NO: 3. In various aspects, the WUS/WOX homeobox polypeptide is a WUS2 polypeptide. In various aspects, the WUS2 polypeptide is a maize, sorghum, rice or *Setaria* sp. WUS2 polypeptide. In various aspects, the WUS2 polypeptide is a maize or rice WUS2 polypeptide. In various aspects, the WUS2 polypeptide is a maize WUS2 polypeptide. In various aspects, the WUS2 polypeptide comprises the amino acid sequence SEQ ID NO:6. In various aspects, the WUS2 polypeptide is encoded by a nucleotide sequence comprising SEQ ID NO: 5. In various aspects, the WUS/WOX homeobox polypeptide is a WUS3 polypeptide. In various aspects, the WUS3 polypeptide is a maize, sorghum, rice or *Setaria* WUS3 polypeptide. In various aspects, the WUS3 polypeptide is a maize or rice WUS3 polypeptide. In various aspects, the WUS3 polypeptide is a maize WUS3 polypeptide. In various aspects, the WUS3 polypeptide comprises the amino sequence of SEQ ID NO:8. In various aspects, the WUS3 polypeptide is encoded by a nucleotide sequence comprising SEQ ID NO:7. In various aspects, the WUS/WOX homeobox polypeptide is a WOX5 polypeptide. In various aspects, the WOX5 polypeptide is a WOX5A polypeptide. In various aspects, the WOX5 polypeptide is a maize, sorghum, rice or *Setaria* WOX5 polypeptide. In various aspects, the WOX5 polypeptide is a maize or rice WOX5 polypeptide. In various aspects, the WOX5 polypeptide is a maize WOX5 polypeptide. In various aspects, the WOX5 polypeptide comprises the amino acid sequence of SEQ ID NO: 14. In various aspects, the WOX5 polypeptide is encoded by a nucleotide sequence comprising SEQ ID NO: 13. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the regenerable plant structure is formed within about 0 to about 7 days of transforming the cell or within about 0 to about 14 days of transforming the cell and the transgenic plant is formed in about 14 days of transforming the cell to about 60 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising a nucleotide sequence encoding a polypeptide comprising two AP2-DNA binding domains; and (b) allowing expression of the polypeptide of (a) in each transformed cell to form a regenerable plant structure in the absence of exogenous cytokinin, wherein no callus is formed; and (c) germinating the regenerable plant structure to form the transgenic plant. In various aspects, the expression of the nucleotide sequence encoding the polypeptide comprising two AP2 binding domains occurs less than 1 day, less than 2 days, less than 5 days, less than 7 days, or less than about 14 days after initiation of transformation. In various aspects, the expression construct further comprises a nucleotide sequence encoding a site-specific recombinase. In various aspects, germinating is performed in the presence of exogenous cytokinin. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the polypeptide comprising the two AP2-DNA binding domains is an ODP2, BBM2, BMN2, or BMN3 polypeptide. In various aspects, the polypeptide comprising the two AP2-DNA binding domains is a monocot polypeptide. In various aspects, the monocot is barley, maize, millet, oats, rice, rye, Setaria sp., sorghum, sugarcane, switchgrass, triticale, turfgrass, or wheat. In various aspects, the monocot is maize, sorghum, rice, or Setaria sp. In various aspects, the monocot is maize or rice. In various aspects, the monocot is maize. In various aspects, the polypeptide comprising the two AP2-DNA binding domains is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the polypeptide comprising the two AP2-DNA binding domains comprises an amino acid sequence of any one of SEQ ID NO: 18, 20, 63, 65, or 67. In various aspects, the polypeptide comprising the two AP2-DNA binding domains is encoded by a nucleotide sequence comprising any one of SEQ ID NO: 17, 19, 21, 62, 64, 66, or 68. In various aspects, the polypeptide comprising the two AP2-DNA binding domains is an ODP2 polypeptide. In various aspects, the ODP2 polypeptide is a monocot polypeptide. In various aspects, the monocot is barley, maize, millet, oats, rice, rye, Setaria sp., sorghum, sugarcane, switchgrass, triticale, turfgrass, or wheat. In various aspects, the monocot is maize, rice, or Setaria sp. In various aspects, the monocot is maize or rice. In various aspects, the ODP2 is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the ODP2 polypeptide comprises the amino acid sequence of any one of SEQ ID NO: 18, 63, 65, or 67. In various aspects, the ODP2 polypeptide is encoded by a nucleotide sequence comprising the sequence of any one of SEQ ID NO: 17, 21, 62, 64, 66, or 68. In various aspects, the polypeptide comprising the two AP2-DNA binding domains is a BBM2 polypeptide. In various aspects, the BBM2 polypeptide is a monocot polypeptide. In various aspects, the monocot is barley, maize, millet, oats, rice, rye, Setaria sp., sorghum, sugarcane, switchgrass, triticale, turfgrass, or wheat. In various aspects, the monocot is maize, sugarcane, rice, or Setaria sp. In various aspects, the monocot is maize or rice. In various aspects, the monocot is maize. In various aspects, the BBM2 polypeptide is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the BBM2 polypeptide comprises the amino acid sequence of SEQ ID NO: 20. In various aspects, the BBM2 polypeptide is encoded by a nucleotide sequence comprising the sequence of SEQ ID NO: 19. In various aspects, the explant is derived from a monocot. In various aspects, the monocot is barley, maize, millet, oats, rice, rye, Setaria sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the regenerable plant structure is formed within about 0 to about 7 days of transforming the cell or within about 0 to about 14 days of transforming the cell and the transgenic plant is formed in about 14 days of transforming the cell to about 60 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; and (ii) a nucleotide sequence encoding a polypeptide comprising two AP2-DNA binding domains; (b) allowing expression of the polypeptide of (a) in each transformed cell to form a regenerable plant structure in the absence of exogenous cytokinin, wherein no callus is formed; and (c) germinating the regenerable plant structure to form the transgenic plant. In an aspect, the expression of the nucleotide sequence encoding the WUS/WOX homeobox polypeptide and the nucleotide sequence encoding the polypeptide comprising two AP2 binding domains occurs less than 1 day, less than 2 days, less than 5 days, less than 7 days, or less than about 14 days after initiation of transformation. In various aspects, germinating is performed in the presence of exogenous cytokinin. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, Setaria sp., sorghum, sugarcane, switchgrass, triticale, turfgrass, or wheat. In various aspects, the monocot is maize, sorghum, rice, or Setaria sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the WUS/WOX homeobox polypeptide is a WUS1, WUS2, WUS3, WOX2A, WOX4, WOX5, or WOX9 polypeptide. In various aspects, the nucleotide sequence encoding the WUS/WOX homeobox polypeptide is a monocot nucleotide. In various aspects, the monocot is barley, maize, millet, oats, rice, rye, Setaria sp., sorghum, sugarcane, switchgrass, triticale, turfgrass, or wheat. In various aspects, the nucleotide sequence encoding the WUS/WOX homeobox polypeptide is a dicot nucleotide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the nucleotide sequence encoding a WUS/WOX homeobox polypeptide encodes an amino acid sequence comprising any one of SEQ ID NOs:4, 6, 8, 10, 12, 14, or 16. In various aspects, the nucleotide sequence encoding a WUS/WOX homeobox polypeptide comprises any one of SEQ ID NOs:3, 5, 7, 9, 11, 13, or 15. In various aspects, the WUS/WOX homeobox polypeptide is a WUS1 polypeptide. In various aspects, the WUS1 polypeptide is a maize, sorghum, rice or Setaria sp. WUS1 polypeptide. In various aspects, the WUS1 polypeptide is a maize or rice WUS1 polypeptide. In various aspects, the WUS1 polypeptide is a maize WUS1 polypeptide. In various aspects, the WUS1 polypeptide comprises an amino acid sequence of SEQ ID NO: 4. In various aspects, the WUS1 polypeptide is encoded by a nucleotide sequence comprising SEQ ID NO: 3. In various aspects, the WUS/WOX homeobox polypeptide is a WUS2 polypeptide. In various aspects, the WUS2 polypeptide is a maize, sorghum, rice or Setaria sp. WUS2 polypeptide. In various aspects, the WUS2 polypeptide is a maize or rice WUS2 polypeptide. In various aspects, the WUS2 polypeptide is a maize WUS2 polypeptide. In various aspects, the WUS2 polypeptide comprises the amino acid sequence SEQ ID NO:6. In various aspects, the WUS2 polypeptide is encoded by a nucleotide sequence comprising SEQ ID NO: 5. In various aspects, the WUS/WOX homeobox polypeptide is a WUS3 polypeptide. In various aspects, the WUS3 polypeptide is a maize, sorghum, rice or Setaria WUS3 polypeptide. In various aspects, the WUS3 polypeptide is a maize or rice WUS3 polypeptide. In various aspects, the WUS3 polypeptide is a maize WUS3 polypeptide. In various aspects, the WUS3 polypeptide comprises the amino sequence of SEQ ID NO:8. In various aspects, the WUS3 polypeptide is encoded by a nucleotide sequence comprising SEQ ID NO:7. In various aspects, the WUS/WOX homeobox polypeptide is a WOX5 polypeptide. In various aspects, the WOX5 polypeptide is a WOX5A polypeptide. In various aspects, the WOX5 polypeptide is a maize, sorghum, rice or Setaria WOX5 polypeptide. In various aspects, the WOX5 polypeptide is a maize or rice WOX5 polypeptide. In various aspects, the WOX5 polypeptide is a maize WOX5 polypeptide. In various aspects, the WOX5 polypeptide comprises the amino acid sequence of SEQ ID NO: 14. In various aspects, the WOX5 polypeptide is encoded by a nucleotide sequence comprising SEQ ID NO: 13. In various aspects, the polypeptide comprising the two AP2-DNA binding domains is an ODP2, BBM2, BMN2, or BMN3 polypeptide. In various aspects, the polypeptide comprising the two AP2-DNA binding domains is a monocot polypeptide. In various aspects, the monocot is barley, maize, millet, oats, rice, rye, Setaria sp., sorghum, sugarcane, switchgrass, triticale, turfgrass, or wheat. In various aspects, the monocot is maize, sorghum, rice, or Setaria sp. In various aspects, the monocot is maize or rice. In various aspects, the monocot is maize. In various aspects, the polypeptide comprising the two AP2-DNA binding domains is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the polypeptide comprising the two AP2-DNA binding domains comprises an amino acid sequence of any one of SEQ ID NO: 18, 20, 63, 65, or 67. In various aspects, the polypeptide comprising the two AP2-DNA binding domains is encoded by a nucleotide sequence comprising any one of SEQ ID NO: 17, 19, 21, 62, 64, 66, or 68. In various aspects, the polypeptide comprising the two AP2-DNA binding domains is an ODP2 polypeptide. In various aspects, the ODP2 polypeptide is a monocot polypeptide. In various aspects, the monocot is barley, maize, millet, oats, rice, rye, Setaria sp., sorghum, sugarcane, switchgrass, triticale, turfgrass, or wheat. In various aspects, the monocot is maize, rice, or Setaria sp. In various aspects, the monocot is maize or rice. In various aspects, the ODP2 is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, Arabidopsis, or cotton. In various aspects, the ODP2 polypeptide comprises the amino acid sequence of any one of SEQ ID NO: 18, 63, 65, or 67. In various aspects, the ODP2 polypeptide is encoded by a nucleotide sequence comprising the sequence of any one of SEQ ID NO: 17, 21, 62, 64, 66, or 68. In various aspects, the polypeptide comprising the two AP2-DNA binding domains is a BBM2 polypeptide. In various aspects, the BBM2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sugarcane, rice, or *Setaria* sp. In various aspects, the monocot is maize or rice. In various aspects, the monocot is maize. In various aspects, the BBM2 polypeptide is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the BBM2 polypeptide comprises the amino acid sequence of SEQ ID NO: 20. In various aspects, the BBM2 polypeptide is encoded by a nucleotide sequence comprising the sequence of SEQ ID NO: 19. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the regenerable plant structure is formed within about 0 to about 7 days of transforming the cell or within about 0 to about 14 days of transforming the cell and the transgenic plant is formed in about 14 days of transforming the cell to about 60 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and (c) germinating the regenerable plant structure of (b) to form the transgenic plant in about 14 days to about 60 days. In various aspects, the expression construct comprises both the nucleotide sequence encoding the WUS/WOX homeobox polypeptide and the nucleotide sequence encoding the polypeptide comprising two AP2-DNA binding domains. In various aspects, the expression construct comprises the nucleotide sequence encoding the WUS/WOX homeobox polypeptide. In various aspects, the expression construct comprises the nucleotide sequence encoding the polypeptide comprising two AP2-DNA binding domains. In various aspects, the expression of the nucleotide sequence encoding the WUS/WOX homeobox polypeptide and/or the nucleotide sequence encoding the polypeptide comprising two AP2 binding domains occurs less than 1 day, less than 2 days, less than 5 days, less than 7 days, or less than about 14 days after initiation of transformation. In various aspects, germinating is performed in the presence of exogenous cytokinin. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and derepression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the WUS/WOX homeobox polypeptide is a WUS1, WUS2, WUS3, WOX2A, WOX4, WOX5, or WOX9 polypeptide. In various aspects, the nucleotide sequence encoding the WUS/WOX homeobox polypeptide is a monocot nucleotide. In various aspects, the monocot is barley, maize, millet, oats, rice, rye, *Setaria* sp., sorghum, sugarcane, switchgrass, triticale, turfgrass, or wheat. In various aspects, the nucleotide sequence encoding the WUS/WOX homeobox polypeptide is a dicot nucleotide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the nucleotide sequence encoding a WUS/WOX homeobox polypeptide encodes an amino acid sequence comprising any one of SEQ ID NOs:4, 6, 8, 10, 12, 14, or 16. In various aspects, the nucleotide sequence encoding a WUS/WOX homeobox polypeptide comprises any one of SEQ ID NOs:3, 5, 7, 9, 11, 13, or 15. In various aspects, the WUS/WOX homeobox polypeptide is a WUS1 polypeptide. In various aspects, the WUS1 polypeptide is a maize, sorghum, rice or *Setaria* sp. WUS1 polypeptide. In various aspects, the WUS1 polypeptide is a maize or rice WUS1 polypeptide. In various aspects, the WUS1 polypeptide is a maize WUS1 polypeptide. In various aspects, the WUS1 polypeptide comprises an amino acid sequence of SEQ ID NO: 4. In various aspects, the WUS1 polypeptide is encoded by a nucleotide sequence comprising SEQ ID NO: 3. In various aspects, the WUS/WOX homeobox polypeptide is a WUS2 polypeptide. In various aspects, the WUS2 polypeptide is a maize, sorghum, rice or *Setaria* sp. WUS2 polypeptide. In various aspects, the WUS2 polypeptide is a maize or rice WUS2 polypeptide. In various aspects, the WUS2 polypeptide is a maize WUS2 polypeptide. In various aspects, the WUS2 polypeptide comprises the amino acid sequence SEQ ID NO:6. In various aspects, the WUS2 polypeptide is encoded by a nucleotide sequence comprising SEQ ID NO: 5. In various aspects, the WUS/WOX homeobox polypeptide is a WUS3 polypeptide. In various aspects, the WUS3 polypeptide is a maize, sorghum, rice or *Setaria* WUS3 polypeptide. In various aspects, the WUS3 polypeptide is a maize or rice WUS3 polypeptide. In various aspects, the WUS3 polypeptide is a maize WUS3 polypeptide. In various aspects, the WUS3 polypeptide comprises the amino sequence of SEQ ID NO:8. In various aspects, the WUS3 polypeptide is encoded by a nucleotide sequence comprising SEQ ID NO:7. In various aspects, the WUS/WOX homeobox polypeptide is a WOX5 polypeptide. In various aspects, the WOX5 polypeptide is a WOX5A polypeptide. In various aspects, the WOX5 polypeptide is a maize, sorghum, rice or *Setaria* WOX5 polypeptide. In various aspects, the WOX5 polypeptide is a maize or rice WOX5 polypeptide. In various aspects, the WOX5 polypeptide is a maize WOX5 polypeptide. In various aspects, the WOX5 polypeptide comprises the amino acid sequence of SEQ ID NO: 14. In various aspects, the WOX5 polypeptide is encoded by a nucleotide sequence comprising SEQ ID NO: 13. In various aspects, the polypeptide comprising the two AP2-DNA binding domains is an ODP2, BBM2, BMN2, or BMN3 polypeptide. In various aspects, the polypeptide comprising the two AP2-DNA binding domains is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize or rice. In various aspects, the monocot is maize. In various aspects, the polypeptide comprising the two AP2-DNA binding domains is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the polypeptide comprising the two AP2-DNA binding domains comprises an amino acid sequence of any one of SEQ ID NO: 18, 20, 63, 65, or 67. In various aspects, the polypeptide comprising the two AP2-DNA binding domains is encoded by a nucleotide sequence comprising any one of SEQ ID NO: 17, 19, 21, 62, 64, 66, or 68. In various aspects, the polypeptide comprising the two AP2-DNA binding domains is an ODP2 polypeptide. In various aspects, the ODP2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, rice, or *Setaria* sp. In various aspects, the monocot is maize or rice. In various aspects, the ODP2 is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the ODP2 polypeptide comprises the amino acid sequence of any one of SEQ ID NO: 18, 63, 65, or 67. In various aspects, the ODP2 polypeptide is encoded by a nucleotide sequence comprising the sequence of any one of SEQ ID NO: 17, 21, 62, 64, 66, or 68. In various aspects, the polypeptide comprising the two AP2-DNA binding domains is a BBM2 polypeptide. In various aspects, the BBM2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sugarcane, rice, or *Setaria* sp. In various aspects, the monocot is maize or rice. In various aspects, the monocot is maize. In various aspects, the BBM2 polypeptide is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the BBM2 polypeptide comprises the amino acid sequence of SEQ ID NO: 20. In various aspects, the BBM2 polypeptide is encoded by a nucleotide sequence comprising the sequence of SEQ ID NO: 19. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the regenerable plant structure is formed within about 0 to about 7 days of transforming the cell or within about 0 to about 14 days of transforming the cell. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In a further aspect, the present disclosure provides methods for producing a transgenic plant, comprising (a) transforming a cell of an explant with an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed and wherein the regenerable plant structure is formed within about 0-7 days or about 0-14 days of transforming the cell; and (c) germinating the regenerable plant structure of (b) to form the transgenic plant in about 14 days to about 60 days. In various aspects, the expression construct comprises both the nucleotide sequence encoding the WUS/WOX homeobox polypeptide and the nucleotide sequence encoding the polypeptide comprising two AP2-DNA binding domains. In various aspects, the expression construct comprises the nucleotide sequence encoding the WUS/WOX homeobox polypeptide. In various aspects, the expression construct comprises the nucleotide sequence encoding the polypeptide comprising two AP2-DNA binding domains. In various aspects, the expression of the nucleotide sequence encoding the WUS/WOX homeobox polypeptide and/or the nucleotide sequence encoding the polypeptide comprising two AP2 binding domains occurs less than 1 day, less than 2 days, less than 5 days, less than 7 days, or less than about 14 days after initiation of transformation. In various aspects, germinating is performed in the presence of exogenous cytokinin. In various aspects, the expression construct further comprises a nucleotide sequence encoding a site-specific recombinase. In various aspects, the site-specific recombinase is FLP, Cre, SSV1, lambda Int, phi C31 Int, HK022, R, Gin, Tn1721, CinH, ParA, Tn5053, Bxb1, TP907-1, or U153. In various aspects, the site-specific recombinase is a destabilized fusion polypeptide. In various aspects, the destabilized fusion polypeptide is TETR(L17G)~CRE or ESR(L17G)~CRE. In various aspects, the nucleotide sequence encoding a site-specific recombinase is operably linked to a constitutive promoter, an inducible promoter, or a developmentally-regulated promoter. In various aspects, the inducible promoter is GLB1, OLE, LTP2, HSP17.7, HSP26, or HSP18A. In various aspects, the inducible promoter is a chemically-inducible promoter. In various aspects, the chemically-inducible promoter is XVE. In various aspects, the chemically-inducible promoter is repressed by TETR, ESR, or CR, and de-repression occurs upon addition of tetracycline-related or sulfonylurea ligands. In various aspects, the repressor is TETR and the tetracycline-related ligand is doxycycline or anhydrotetracycline. In various aspects, the repressor is ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron. In various aspects, the nucleotide sequence encoding the WUS/WOX homeobox polypeptide is operably linked to a constitutive promoter. In various aspects, the constitutive promoter is UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2). In various aspects, the nucleotide sequence encoding the WUS/WOX homeobox polypeptide is operably linked to an inducible promoter or a developmentally-regulated promoter. In various aspects, the nucleotide sequence encoding a polypeptide comprising two AP2-DNA binding domains is operably linked to an inducible promoter or a developmentally-regulated promoter. In various aspects, the developmentally-regulated promoter is a PLTP promoter. In various aspects, the PLTP promoter is derived from a monocot. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize, sorghum or rice. In various aspects, the monocot is maize. In various aspects, the PLTP promoter is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the PLTP promoter comprises any one of SEQ ID NO: 1-2 or 55-61. In various aspects, the PLTP promoter comprises any one of SEQ ID NO: 1 or 2. In various aspects, the inducible promoter is an auxin-inducible promoter. In various aspects, the auxin inducible promoter is an AXIG1. In various aspects, the AXIG1 promoter comprises the nucleotide sequence of SEQ ID NO: 39. In various aspects, the promoter comprises an auxin-response element. In various aspects, the promoter contains one or more DR5 enhancer motifs. In various aspects, the promoter is a weak constitutive promoter modified for repression and de-repression. In various aspects, one or more operator sequences in the promoter have been positioned near or overlapping the TATA box and/or the transcription start site. In various aspects, the promoter is NOS, AXIG1, ZM-GOS2, CC-UBI1-PRO or ZM-ADF4-PRO. In various aspects, the promoter is a DR5 promoter comprising the nucleotide sequence of SEQ ID NO: 40. In various aspects, the promoter is a de-repressible promoter. In various aspects, the de-repressible promoter is TETR, ESR, or CR. In various aspects, the WUS/WOX homeobox polypeptide is a WUS1, WUS2, WUS3, WOX2A, WOX4, WOX5, or WOX9 polypeptide. In various aspects, the nucleotide sequence encoding the WUS/WOX homeobox polypeptide is a monocot nucleotide. In various aspects, the monocot is barley, maize, millet, oats, rice, rye, *Setaria* sp., sorghum, sugarcane, switchgrass, triticale, turfgrass, or wheat. In various aspects, the nucleotide sequence encoding the WUS/WOX homeobox polypeptide is a dicot nucleotide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the nucleotide sequence encoding a WUS/WOX homeobox polypeptide encodes an amino acid sequence comprising any one of SEQ ID NOs:4, 6, 8, 10, 12, 14, or 16. In various aspects, the nucleotide sequence encoding a WUS/WOX homeobox polypeptide comprises any one of SEQ ID NOs:3, 5, 7, 9, 11, 13, or 15. In various aspects, the WUS/WOX homeobox polypeptide is a WUS1 polypeptide. In various aspects, the WUS1 polypeptide is a maize, sorghum, rice or *Setaria* sp. WUS1 polypeptide. In various aspects, the WUS1 polypeptide is a maize or rice WUS1 polypeptide. In various aspects, the WUS1 polypeptide is a maize WUS1 polypeptide. In various aspects, the WUS1 polypeptide comprises an amino acid sequence of SEQ ID NO: 4. In various aspects, the WUS1 polypeptide is encoded by a nucleotide sequence comprising SEQ ID NO: 3. In various aspects, the WUS/WOX homeobox polypeptide is a WUS2 polypeptide. In various aspects, the WUS2 polypeptide is a maize, sorghum, rice or *Setaria* sp. WUS2 polypeptide. In various aspects, the WUS2 polypeptide is a maize or rice WUS2 polypeptide. In various aspects, the WUS2 polypeptide is a maize WUS2 polypeptide. In various aspects, the WUS2 polypeptide comprises the amino acid sequence SEQ ID NO:6. In various aspects, the WUS2 polypeptide is encoded by a nucleotide sequence comprising SEQ ID NO: 5. In various aspects, the WUS/WOX homeobox polypeptide is a WUS3 polypeptide. In various aspects, the WUS3 polypeptide is a maize, sorghum, rice or *Setaria* WUS3 polypeptide. In various aspects, the WUS3 polypeptide is a maize or rice WUS3 polypeptide. In various aspects, the WUS3 polypeptide is a maize WUS3 polypeptide. In various aspects, the WUS3 polypeptide comprises the amino sequence of SEQ ID NO:8. In various aspects, the WUS3 polypeptide is encoded by a nucleotide sequence comprising SEQ ID NO:7. In various aspects, the WUS/WOX homeobox polypeptide is a WOX5 polypeptide. In various aspects, the WOX5 polypeptide is a WOX5A polypeptide. In various aspects, the WOX5 polypeptide is a maize, sorghum, rice or *Setaria* WOX5 polypeptide. In various aspects, the WOX5 polypeptide is a maize or rice WOX5 polypeptide. In various aspects, the WOX5 polypeptide is a maize WOX5 polypeptide. In various aspects, the WOX5 polypeptide comprises the amino acid sequence of SEQ ID NO: 14. In various aspects, the WOX5 polypeptide is encoded by a nucleotide sequence comprising SEQ ID NO: 13. In various aspects, the polypeptide comprising the two AP2-DNA binding domains is an ODP2, BBM2, BMN2, or BMN3 polypeptide. In various aspects, the polypeptide comprising the two AP2-DNA binding domains is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sorghum, rice, or *Setaria* sp. In various aspects, the monocot is maize or rice. In various aspects, the monocot is maize. In various aspects, the polypeptide comprising the two AP2-DNA binding domains is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the polypeptide comprising the two AP2-DNA binding domains comprises an amino acid sequence of any one of SEQ ID NO: 18, 20, 63, 65, or 67. In various aspects, the polypeptide comprising the two AP2-DNA binding domains is encoded by a nucleotide sequence comprising any one of SEQ ID NO: 17, 19, 21, 62, 64, 66, or 68. In various aspects, the polypeptide comprising the two AP2-DNA binding domains is an ODP2 polypeptide. In various aspects, the ODP2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, rice, or *Setaria* sp. In various aspects, the monocot is maize or rice. In various aspects, the ODP2 is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the ODP2 polypeptide comprises the amino acid sequence of any one of SEQ ID NO: 18, 63, 65, or 67. In various aspects, the ODP2 polypeptide is encoded by a nucleotide sequence comprising the sequence of any one of SEQ ID NO: 17, 21, 62, 64, 66, or 68. In various aspects, the polypeptide comprising the two AP2-DNA binding domains is a BBM2 polypeptide. In various aspects, the BBM2 polypeptide is a monocot polypeptide. In various aspects, the monocot is barley, maize, millet, oats, rice, rye, *Setaria* sp., sorghum, sugarcane, switchgrass, triticale, turfgrass, or wheat. In various aspects, the monocot is maize, sugarcane, rice, or *Setaria* sp. In various aspects, the monocot is maize or rice. In various aspects, the monocot is maize. In various aspects, the BBM2 polypeptide is a dicot polypeptide. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the BBM2 polypeptide comprises the amino acid sequence of SEQ ID NO: 20. In various aspects, the BBM2 polypeptide is encoded by a nucleotide sequence comprising the sequence of SEQ ID NO: 19. In various aspects, the explant is derived from a monocot. In various aspects, the monocot is barley, maize, millet, oats, rice, rye, *Setaria* sp., sorghum, sugarcane, switchgrass, triticale, turfgrass, or wheat. In various aspects, the explant is derived from a dicot. In various aspects, the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In various aspects, the method is carried out in the absence of rooting medium. In various aspects, the method is carried out in the presence of rooting medium. In various aspects, the explant is an immature embryo. In various aspects, the immature embryo is a 1-5 mm immature embryo. In various aspects, the immature embryo is a 3.5-5 mm immature embryo. In various aspects, exogenous cytokinin is used during germinating after about 7 days of transforming the cell or after about 14 days of transforming the cell. In various aspects, the expression of a polypeptide of (a) is transient. In various aspects, a seed from the plant produced by the method is provided.

In an aspect, the present disclosure further provides kits comprising (a) an expression construct comprising (i) a nucleotide sequence encoding a WUS/WOX homeobox polypeptide; or (ii) a nucleotide sequence encoding a polypeptide comprising two AP2-DNA binding domains; or (iii) a combination of (i) and (ii); and (b) instructions for obtaining a plant regenerable structure in the absence of exogenous cytokinin, wherein no callus is formed. In various aspects, the kit provides instructions for obtaining a transformed plant within about 14 days to about 60 days. In various aspects, the kit provides instructions for obtaining a plant from an explant transformed using the kit.

In an aspect, the present disclosure further provides kits comprising (a) an expression construct comprising a nucleotide sequence encoding a WUS/WOX homeobox polypeptide; and (b) instructions for obtaining a plant regenerable structure in the absence of exogenous cytokinin, wherein no callus is formed. In various aspects, the kit provides instructions for obtaining a transformed plant within about 14 days to about 60 days. In various aspects, the kit provides instructions for obtaining a plant from an explant transformed using the kit.

In an aspect, the present disclosure further provides kits comprising (a) an expression construct comprising a nucleotide sequence encoding a polypeptide comprising two AP2-DNA binding domains; or (iii) a combination of (i) and (ii); and (b) instructions for obtaining a plant regenerable structure in the absence of exogenous cytokinin, wherein no callus is formed. In various aspects, the kit provides instructions for obtaining a transformed plant within about 14 days to about 60 days. In various aspects, the kit provides instructions for obtaining a plant from an explant transformed using the kit.

In a further aspect, the present disclosure provides a seed from the plant produced from the methods disclosed herein.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

DETAILED DESCRIPTION

Figure 1:
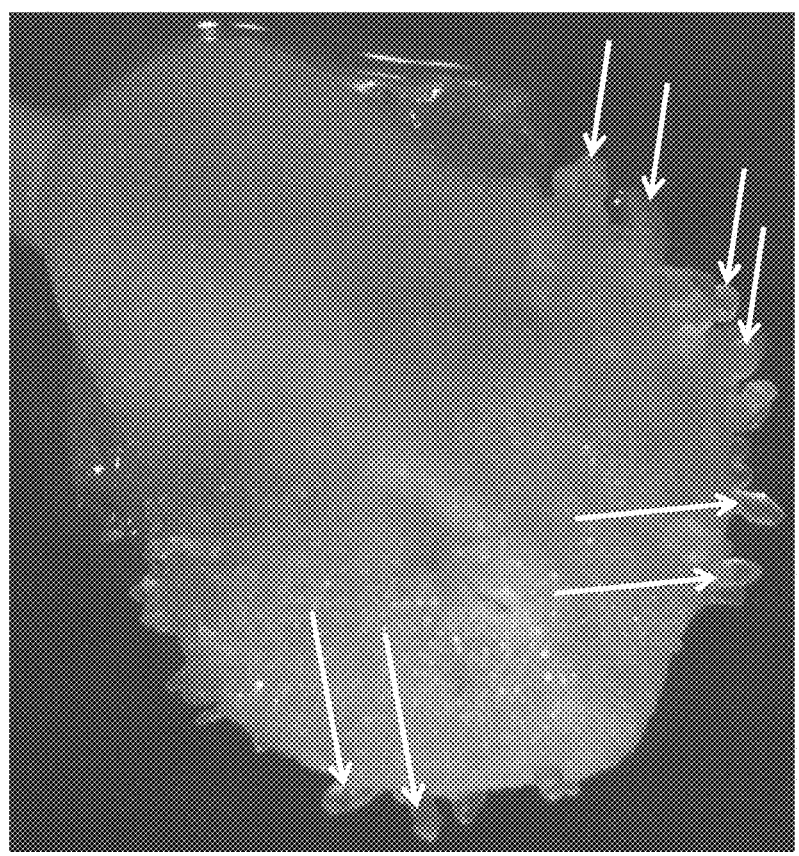
FIG. 1 shows a representative image of an immature embryo treated using the disclosed methods (see Example 5). The arrows indicate representative newly formed embryos on the surface following treatment.

The disclosures herein will be described more fully hereinafter with reference to the accompanying drawings, in which some, but not all possible aspects are shown. Indeed, disclosures may be embodied in many different forms and should not be construed as limited to the aspects set forth herein; rather, these aspects are provided so that this disclosure will satisfy applicable legal requirements.

Many modifications and other aspects disclosed herein will come to mind to one skilled in the art to which the disclosed compositions and methods pertain having the benefit of the teachings presented in the following descriptions and the associated drawings. Therefore, it is to be understood that the disclosures are not to be limited to the specific aspects disclosed and that modifications and other aspects are intended to be included within the scope of the appended claims. Although specific terms are employed herein, they are used in a generic and descriptive sense only and not for purposes of limitation.

It is also to be understood that the terminology used herein is for the purpose of describing particular aspects only and is not intended to be limiting. As used in the specification and in the claims, the term "comprising" can include the aspect of "consisting of." Unless defined otherwise, all technical and scientific terms used herein have the same meaning as commonly understood by one of ordinary skill in the art to which the disclosed compositions and methods belong. In this specification and in the claims which follow, reference will be made to a number of terms which shall be defined herein.

I. Methods and Compositions for Producing Transgenic Plants

The present disclosure comprises methods and compositions for producing a transgenic plant, comprising (a) transforming a cell of an explant with an expression construct comprising: (i) a nucleotide sequence encoding a WUS/WOX homeobox polypeptide; (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of exogenous cytokinin, wherein no callus is formed; and (c) germinating the regenerable plant structure to form the transgenic plant. The regenerable plant structure is produced within about 0-7 days or about 0-14 days of transformation. In an aspect, the germinating comprises transferring the regenerable plant structure to a maturation medium comprising an exogenous cytokinin and forming the transgenic plant. In an aspect, the nucleotide sequence encoding a WUS/WOX homeobox polypeptide is capable of stimulating formation of a regenerable plant structure. In an aspect, the nucleotide sequence encoding a polypeptide comprising two AP2-DNA binding domains is capable of stimulating formation of a regenerable plant structure.

In an aspect, expression of the polypeptide of (a) in each transformed cell of the method is controlled. The controlled expression is pulsed for a particular period of time. The control of expression of the polypeptide of (a) can be achieved by a variety of methods as disclosed herein below.

It is to be understood that the methods of the present disclosure produce single regenerable plant structures that form directly from a single cell on, or within, the explant that has been transformed, with no intervening single-cell-derived cell or tissue proliferation occurring before initiation of the regenerable plant structure. In contrast, previously described methods of transformation and regeneration known in the art involve intervening single-cell-derived cell- or tissue-proliferation, which comprise types of growth patterns referred to as callus, non-differentiated callus, embryogenic callus and organogenic callus. In various aspects, the term "callus" refers to an undifferentiated cell clump under uncontrolled growth. A callus can be obtained by culturing a differentiated cell of a plant tissue in a medium containing a plant growth regulator such as auxin (e.g., 2,4-D) or cytokinin (wherein the medium with cytokinin is referred to as dedifferentiation medium). Examples of auxins that can be added to tissue culture medium to stimulate embryogenesis include the naturally occurring auxins such as indole-3-acetic acid (IAA), chloroindole-3-acetic acid (CL-IAA), 2-phenylacetic acid (PAA), indole-3-propionic acid (IPA) and indole-3-buteric acid (IBA), in addition to synthetic auxins such as 1-naphthaleneacetic acid (NAA), 2,4-dichlorophenoxyacetic acid (2,4-D) and 2,4,5-trichlorophenoxyacetic acid (2,4,5-T). Examples of cytokinins that can be added to tissue culture medium to stimulate morphogenesis (and in particular meristem and shoot development) include benzylaminopurine (BAP), zeatin, kinetin, thidiazuron (TDZ), meta-topolin, and methoxy-topolins. Auxins and cytokinins which are added to tissue culture medium are exogenous. It is to be further understood that previously described methods of transformation and regeneration known in the art also involve intervening single-cell-derived or tissue-proliferation, which comprise types of growth patterns referred to as meristem proliferation, which encompasses de novo meristem formation (Gordon Kamm et al. (2007) Development 134: 3539-3548), multiple shoot formation (Zhong et al. (1992) Planta 187:483-489) and green tissue culture (Cho et al. (1998) Plant Sci 138:229-244; Cho et al. (2004) Plant Cell Rep 22:483-489), all requiring cytokinin in the medium (e.g., U.S. Pat. No. 8,395,020B2; U.S. Pat. No. 8,581,035B2).

In the disclosed methods, various explants can be used, including immature embryos, 1-5 mm zygotic embryos, 3-5 mm embryos, and embryos derived from mature ear-derived seed, leaf bases, leaves from mature plants, leaf tips, immature influorescences, tassel, immature ear, and silks. In various aspects, the plant-derived explant used for transformation includes immature embryos, 1-5 mm zygotic embryos, and 3.5-5 mm embryos. In an aspect, the embryos used in the disclosed methods can be derived from mature ear-derived seed, leaf bases, leaves from mature plants, leaf tips, immature influorescences, tassel, immature ear, and silks.

Regenerable plant structure is defined as a multicellular structure capable of forming a fully functional fertile plant, such as, but not limited to, somatic embryos, embryogenic callus, somatic meristems, and/or organogenic callus.

Somatic embryo is defined as a multicellular structure that progresses through developmental stages that are similar to the development of a zygotic embryo, including formation of globular and transition-stage embryos, formation of an embryo axis and a scutellum, and accumulation of lipids and starch. Single somatic embryos derived from a zygotic embryo germinate to produce single non-chimeric plants, which may originally derive from a single-cell.

Embryogenic callus is defined as a friable or non-friable mixture of undifferentiated or partially undifferentiated cells which subtend proliferating primary and secondary somatic embryos capable of regenerating into mature fertile plants.

Somatic meristem is defined as a multicellular structure that is similar to the apical meristem which is part of a seed-derived embryo, characterized as having an undifferentiated apical dome flanked by leaf primorida and subtended by vascular initials, the apical dome giving rise to an above-ground vegetative plant. Such somatic meristems can form single or fused clusters of meristems.

Organogenic callus is defined as a compact mixture of differentiated growing plant structures, including but not limited to apical meristems, root meristems, leaves and roots.

Germination is the growth of a regenerable structure to form a plantlet which continues growing to produce a plant.

A transgenic plant is defined as a mature, fertile plant that contains a transgene.

The explant used in the disclosed methods can be derived from a monocot, including, but not limited to, barley, maize, millet, oats, rice, rye, Setaria sp., sorghum, sugarcane, switchgrass, triticale, turfgrass, or wheat. Alternatively, the explant used in the disclosed methods can be derived from a dicot, including, but not limited to, kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton.

In a further aspect, the explant used in the disclosed methods can be derived from a plant that is a member of the family Poaceae. Non-limiting examples of suitable plants from which an explant can be derived include grain crops, including, but not limited to, barley, maize (corn), oats, rice, rye, sorghum, wheat, millet, triticale; leaf and stem crops, including, but not limited to, bamboo, marram grass, meadow-grass, reeds, ryegrass, sugarcane; lawn grasses, ornamental grasses, and other grasses such as switchgrass and turfgrass.

In a further aspect, the explant used in the disclosed methods can be derived from any plant, including higher plants, e.g., classes of Angiospermae and Gymnospermae. Plants of the subclasses of the Dicotylodenae and the Monocotyledonae are suitable. Suitable species may come from the family Acanthceae, Alliaceae, Alstroemeriaceae, Amaryllidaceae, Apocynaceae, Arecaceae, Asteraceae, Berberidaceae, Bixaceae, Bras sicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, and Vitaceae.

Suitable species from which the explant used in the disclosed methods can be derived include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

In a further aspect, the explant used in the disclosed methods can be derived from a plant that is important or interesting for agriculture, horticulture, biomass for the production of liquid fuel molecules and other chemicals, and/or forestry. Non-limiting examples include, for instance, *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Arundo donax* (giant reed), *Secale cereale* (rye), *Salix* spp. (willow), *Eucalyptus* spp. (*eucalyptus*), *Triticosecale* spp. (*triticum*—wheatxrye), Bamboo, *Carthamus tinctorius* (safflower), *Jatropha curcas* (jatropha), *Ricinus communis* (castor), *Elaeis guineensis* (palm), *Linum usitatissimum* (flax), *Brassica juncea, Manihot esculenta* (cassava), *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (*petunia*), *Poinsettia pulcherrima* (poinsettia), *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass), *Phleum pratense* (timothy), and conifers. Of interest are plants grown for energy production, so called energy crops, such as cellulose-based energy crops like *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (*eucalyptus*), *Triticosecale* spp. (*triticum*—wheatxrye), and Bamboo; and starch-based energy crops like *Zea mays* (corn) and *Manihot esculenta* (cassava); and sucrose-based energy crops like *Saccharum* sp. (sugarcane) and *Beta vulgaris* (sugarbeet); and biodiesel-producing energy crops like *Glycine max* (soybean), *Brassica napus* (canola), *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea.*

As used herein, a "biomass renewable energy source plant" means having or producing material (either raw or processed) that comprises stored solar energy that can be converted to electrical energy, liquid fuels, and other useful chemicals. In general terms, such plants comprise dedicated energy crops as well as agricultural and woody plants. Examples of biomass renewable energy source plants include: *Panicum virgatum* (switchgrass), *Sorghum bicolor* (sorghum, sudangrass), *Miscanthus giganteus* (*miscanthus*), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (*eucalyptus*), *Triticosecale* spp. (*triticum*—wheat×rye), Bamboo, *Zea mays* (corn), *Manihot esculenta* (cassava), *Saccharum* sp. (sugarcane), *Beta vulgaris* (sugarbeet), *Glycine max* (soybean), *Brassica napus* (canola), *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

In an aspect, the expression construct comprises both a nucleotide sequence encoding a WUS/WOX homeobox polypeptide and a nucleotide sequence encoding a polypeptide comprising two AP2-DNA binding domains. In various aspects, expression of a nucleotide sequence encoding a WUS/WOX homeobox polypeptide and a nucleotide sequence encoding a polypeptide comprising two AP2 binding domains occurs for less than 1 day, less than 2 days, less than 5 days, less than 7 days, or less than 14 days after initiation of transformation.

In an aspect, the expression construct comprises a nucleotide sequence encoding a WUS/WOX homeobox polypeptide. In various aspects, expression of a nucleotide sequence encoding a WUS/WOX homeobox polypeptide occurs for less than 1 day, less than 2 days, less than 5 days, less than 7 days, or less than 14 days after initiation of transformation.

In an aspect, the expression construct comprises a nucleotide sequence encoding a polypeptide comprising two AP2-DNA binding domains. In various aspects, expression of a nucleotide sequence encoding a polypeptide comprising two AP2 binding domains occurs for less than 1 day, less than 2 days, less than 5 days, less than 7 days, or less than 14 days after initiation of transformation.

In an aspect, the nucleotide sequence encoding the WUS/WOX homeobox polypeptide; the nucleotide sequence encoding a polypeptide comprising two AP2-DNA binding domains; or both nucleotide sequences can be targeted for excision by a site-specific recombinase. Thus, the expression of the nucleotide sequence encoding the WUS/WOX homeobox polypeptide; the nucleotide sequence encoding a polypeptide comprising two AP2-DNA binding domains; or both nucleotide sequences can be controlled by excision at a desired time post-transformation. It is understood that when a site-specific recombinase is used to control the expression of the nucleotide sequence encoding the WUS/WOX homeobox polypeptide; the nucleotide sequence encoding a polypeptide comprising two AP2-DNA binding domains; or both nucleotide sequences in the expression construct, the expression construct comprises appropriate site-specific excision sites flanking the polynucleotide sequences to be excised, e.g., Cre lox sites if Cre recombinase is utilized. It is not necessary that the site-specific recombinase be co-located on the expression construct comprising the nucleotide sequence encoding the WUS/WOX homeobox polypeptide; the nucleotide sequence encoding a polypeptide comprising two AP2-DNA binding domains; or both nucleotide sequences. However, in an aspect, the expression construct further comprises a nucleotide sequence encoding a site-specific recombinase.

The site-specific recombinase used to control expression of the nucleotide sequence encoding the WUS/WOX homeobox polypeptide; the nucleotide sequence encoding a polypeptide comprising two AP2-DNA binding domains; or both polynucleotide sequences, can be chosen from a variety of suitable site-specific recombinases. For examples, in various aspects, the site-specific recombinase is FLP, Cre, SSV1, lambda Int, phi C31 Int, HK022, R, Gin, Tn1721, CinH, ParA, Tn5053, Bxb1, TP907-1, or U153. The site-specific recombinase can be a destabilized fusion polypeptide. The destabilized fusion polypeptide can be TETR (G17A)~CRE or ESR(G17A)~CRE.

In an aspect, the nucleotide sequence encoding a site-specific recombinase is operably linked to a constitutive promoter, an inducible promoter, or a developmentally-regulated promoter. Suitable developmentally regulated promoters include, GLB1, OLE, and Lipid Transfer Protein2 (LTP2) (Kalla et al., 1994. Plant J. 6:849-860 and U.S. Pat. No. 5,525,716). Suitable inducible promoters include environmentally inducible heat shock promoters including HSP17.7, HSP26, or HSP18A. Alternatively, the inducible promoter operably linked to the site-specific recombinase can be a chemically inducible promoter, for example the XVE promoter.

In an aspect, the chemically inducible promoter operably linked to the site-specific recombinase is XVE. The chemically-inducible promoter can be repressed by the tetraycline repressor (TETR), the ethametsulfuron repressor (ESR), or the chlorsulfuron repressor (CR), and de-repression occurs upon addition of tetracycline-related or sulfonylurea ligands. The repressor can be TETR and the tetracycline-related ligand is doxycycline or anhydrotetracycline. (Gatz, C., Frohberg, C. and Wendenburg, R. (1992) Stringent repression and homogeneous de-repression by tetracycline of a modified CaMV 35S
promoter in intact transgenic tobacco plants, Plant J. 2, 397-404). Alternatively, the repressor can be ESR and the sulfonylurea ligand is ethametsulfuron, chlorsulfuron, metsulfuron-methyl, sulfometuron methyl, chlorimuron ethyl, nicosulfuron, primisulfuron, tribenuron, sulfosulfuron, trifloxysulfuron, foramsulfuron, iodosulfuron, prosulfuron, thifensulfuron, rimsulfuron, mesosulfuron, or halosulfuron (US20110287936 incorporated herein by reference in its entirety).

In an aspect, when the expression construct comprises site-specific recombinase excision sites, the nucleotide sequence encoding the WUS/WOX homeobox polypeptide; the nucleotide sequence encoding a polypeptide comprising two AP2-DNA binding domains; or both nucleotide sequences can be operably linked to an auxin inducible promoter, a developmentally regulated promoter, or a constitutive promoter. Exemplary constitutive promoters useful in this context include UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of the 35S PRO (or longer versions of the 35S promoter, and ZM-ADF PRO (ALT2). Exemplary auxin inducible promoters useful in this context include AXIG1 and DR5. Exemplary developmentally regulated promoters useful in this context include PLTP, PLTP1, PLTP2, PLTP3, LGL, LEA-14A, and LEA-D34.

The appropriate duration for expression of the nucleotide sequence encoding a WUS/WOX homeobox polypeptide; the nucleotide sequence encoding a polypeptide comprising two AP2-DNA binding domains; or both nucleotide sequences can be achieved by use of a developmentally-regulated promoter, e.g., a promoter such as a Phospholipid Transfer Protein (PLTP). PLTP promoters include PLTP, PLTP1, PLTP2, and PLTP3 as further described below. In a particular aspect, the PLTP promoter comprises any one of SEQ ID NO: 1-2, and 55-61. The PLTP promoter used can be a *Zea mays* or *Sorghum bicolor* PLTP promoter such as that of SEQ ID NO: 1 or 2 (U.S. Provisional Appl. No. 62/271,230 herein incorporated by reference in its entirety). Other appropriate developmentally-regulated promoters that can be used with the methods of the present disclosure include the promoters derived from genes encoding the fructose-1,6-bisphosphatase protein, NAD(P)-binding Rossmann-Fold protein, adipocyte plasma membrane-associated protein-like protein, Rieske [2Fe-2S] iron-sulfur domain protein, chlororespiratory reduction 6 protein, D-glycerate 3-kinase, chloroplastic-like protein, chlorophyll a-b binding protein 7, chloroplastic-like protein, ultraviolet-B-repressible protein, Soul heme-binding family protein, Photosystem I reaction center subunit psi-N protein, and short-chain dehydrogenase/reductase protein. The promoters can be derived from the genes encoding the foregoing proteins in monocot plants, such as maize, rice, or sorghum. Suitable developmentally-regulated promoters useful in the methods of the present disclosure include those shown in SEQ ID NOs: 1-2, 28-40, 55-61, 81-83 and 86-88 and 106.

In an aspect, the nucleotide sequence encoding the WUS/WOX homeobox polypeptide; the nucleotide sequence encoding a polypeptide comprising two AP2-DNA binding domains; or both polynucleotide sequences can be operably linked to an auxin-inducible promoter. In various aspects, the auxin-inducible promoter can be AXIG1. In particular, the auxin-inducible promoter can be SEQ ID NO:39. The promoter can also comprise one or more auxin-response elements. In a further aspect, the promoter can comprise one or more DR5 motifs. In particular, the promoter can be SEQ ID NO:40.

In an aspect, the promoter is a weak constitutive promoter modified for repression and de-repression. In a further aspect, the weak constitutive promoter modified for repression and de-repression comprises one or more operator sequences in the promoter that have been positioned near or overlapping the TATA box and/or the transcription start site. For example, suitable promoters of this type include, but are not limited to, the NOS, IN2-2, the −135 version of 35S, CC-UBI1-PRO and ZM-ADF4-PRO promoters.

In an aspect, the nucleotide sequence encoding the WUS/WOX homeobox polypeptide; the nucleotide sequence encoding a polypeptide comprising two AP2-DNA binding domains; or both nucleotide sequences can be operably linked to a developmentally-regulated promoter. Suitable developmentally-regulated promoters include promoters derived from the plant genes for Fructose-1,6-bisphosphatase, NAD(P)-binding Rossmann-Fold Protein, Adipocyte plasma membrane-associated protein-like protein, Rieske [2Fe-2S] iron-sulphur domain protein, Chlororespiratory reduction 6 protein, D-glycerate 3-kinase, chloroplastic-like protein, Chlorophyll a-b binding protein 7, chloroplastic-like protein, Ultraviolet-B-repressible protein, Soul heme-binding family protein, Photosystem I reaction center subunit psi-N protein, and Short-chain dehydrogenase/reductase. In various aspects, these promoters are derived from the corresponding genes in monocots such as maize, rice, and the like. Alternatively, these promoters can be derived from the corresponding genes in dicots. In particular aspects, the developmentally-regulated promoters comprise any one of SEQ ID NOS: 1-2, 28-40, 55-61, 81-83 and 86-88 and 106.

In an aspect, the nucleotide sequence encoding the WUS/WOX homeobox polypeptide; the nucleotide sequence encoding a polypeptide comprising two AP2-DNA binding domains; or both nucleotide sequences can be operably linked to a de-repressible promoter. Useful de-repressible promoters include 35S:Top3, NOS::Top, NOS:Top2, UBI:Top3, BSV:Top3, AXIG1:Top, IN2-2:Top and DR5:Top (where Top is the abbreviation of the 18-base operator sequence to which either TETR, ESR or CR bind to repress expression).

In an aspect, the present disclosure provides transformation methods that allow positive growth selection. One skilled in the art can appreciate that conventional plant transformation methods have relied predominantly on negative selection schemes, in which an antibiotic or herbicide (a negative selective agent) is used to inhibit or kill non-transformed cells or tissues, and the transgenic cells or tissues continue to grow due to expression of a resistance gene. In contrast, the methods of the present disclosure can be used with no application of a negative selective agent. Thus, although wild-type cells can grow unhindered, by comparison cells containing the disclosed WUS2 and ODP2 expression cassettes can be readily identified due to their accelerated growth rate relative to the surrounding wild-type tissue. In addition to simply observing faster growth, the methods of the present disclosure provide transgenic cells containing the WUS2 and ODP2 expression cassettes that exhibit more rapid morphogenesis, manifested as regenerable plant structure formation, relative to non-transformed cells. Accordingly, such differential growth and morphogenic development can be used to easily distinguish transgenic regenerable plant structures from the surrounding non-transformed tissue, a process which is termed herein as "positive growth selection."

In various aspects, the methods of the present disclosure can be carried out without using a rooting medium. Alternatively, in an aspect, the methods of the present disclosure can be carried out using a rooting medium. As used herein, "rooting medium" or "selective rooting medium" refers to a tissue culture medium comprising basal salts, carbon sources, vitamins, minerals and plant phytohormones. In an aspect, the plant phytohormones can be provided at varying concentrations or ratios, wherein root tissues develop and proliferate from cells placed upon the selective rooting medium. In an aspect, the selective rooting medium contains glufosinate, imazapyr, ethametsulfuron, mannose or other selective agents. In an aspect, the selective rooting medium contains auxin and cytokinin, cytokinin alone, or no plant phytohormones.

In an aspect, the methods of the present disclosure are carried out without using a cytokinin during regenerable plant structure formation and/or during germination. In a further aspect, the methods of the present disclosure can be carried out without using a cytokinin between transformation and at least about 7 days after initiating transformation. In a further aspect, the methods of the present disclosure can be carried out without using a cytokinin between transformation and at least about 14 days after initiating transformation.

In an aspect, the nucleotide sequence encoding the WUS/WOX homeobox polypeptide; the nucleotide sequence encoding a polypeptide comprising two AP2-DNA binding domains; or each nucleotide sequence is operably linked to a PLTP promoter. PLTP promoters include PLTP, PLTP1, PLTP2, and PLTP3. The PLTP promoter can be derived from a monocot, including, but not limited to, maize, barley, oats, rye, sugarcane, millet, sorghum, wheat, *Setaria* sp., or rice. In a further aspect, the PLTP promoter is a maize, rice, or *Setaria* sp. PLTP promoter. In a particular aspect, the PLTP promoter comprises SEQ ID NO: 1-2 and 55-61. In a particular aspect, the PLTP promoter is a maize or rice PLTP promoter. In a further aspect, the PLTP promoter is a maize PLTP promoter. In a further aspect, the PLTP promoter is a rice PLTP promoter. In an aspect, the PLTP promoter comprises SEQ ID NO: 1 or 2. The PLTP promoter can also be derived from a dicot, including, but not limited to, kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. Other developmentally regulated promoters useful in this context include LGL, LEA-14A, and LEA-D34. In a particular aspect, other promoters useful in the present methods include any one of SEQ ID NO: 28-40, 81-83, 86-88, and 106.

In an aspect, the present disclosure comprises methods for producing a transgenic plant, comprising (a) transforming a cell of an explant with an expression construct comprising: (i) a nucleotide sequence encoding a WUS/WOX homeobox polypeptide; (ii) a nucleotide sequence encoding a polypeptide comprising two AP2-DNA binding domains; or (iii) a combination thereof; and (b) allowing expression of a polypeptide of (a) in each transformed cell to form a regenerable plant structure in the absence of exogenous cytokinin, wherein no callus is formed; and (c) germinating the regenerable plant structure to form the transgenic plant; wherein the WUS/WOX homeobox polypeptide comprises the amino acid sequence of any one of SEQ ID NO: 4, 6, 8, 10, 12, 14, or 16; or wherein the WUS/WOX homeobox polypeptide is encoded by the nucleotide sequence of any one of SEQ ID NO: 3, 5, 7, 9, 11, 13, or 15; and wherein the polypeptide comprising two AP2-DNA binding domains comprises the amino acid sequence of any one of SEQ ID NO: 18, 20, 63, 65, or 67; or wherein the polypeptide comprising two AP2-DNA binding domains is encoded by the nucleotide sequence of any one of SEQ ID NO: 17, 19, 21, 62, 64, 66, or 68.

The regenerable plant structure is produced within about 0-7 days or about 0-14 days of transformation. In an aspect, the germinating comprises transferring the regenerable plant structure to a maturation medium comprising an exogenous cytokinin and forming the transgenic plant. In an aspect, the nucleotide sequence encoding a WUS/WOX homeobox polypeptide is capable of stimulating formation of a regenerable plant structure. In an aspect, the nucleotide sequence encoding a polypeptide comprising two AP2-DNA binding domains is capable of stimulating formation of a regenerable plant structure.

In an aspect, the present disclosure comprises methods for producing a transgenic plant, comprising (a) transforming a cell of an explant with an expression construct comprising: (i) a nucleotide sequence encoding a WUS2 polypeptide; (ii) a nucleotide sequence encoding a ODP2 polypeptide; or (iii) a combination thereof; and (b) allowing expression of a polypeptide of (a) in each transformed cell to form a regenerable plant structure in the absence of exogenous cytokinin, wherein no callus is formed; and (c) germinating the regenerable plant structure to form the transgenic plant; wherein the WUS2 polypeptide comprises the amino acid sequence of SEQ ID NO: 4; or wherein the WUS2 polypeptide is encoded by the nucleotide sequence of SEQ ID NO: 3; and wherein the ODP2 polypeptide comprises the amino acid sequence of SEQ ID NO: 18, 63, 65, or 67; or wherein the polypeptide comprising two AP2-DNA binding domains is encoded by the nucleotide sequence of any one of SEQ ID NO: 17, 21, 62, 64, 66, or 68.

In an aspect, the present disclosure comprises methods for producing a transgenic plant, comprising (a) transforming a cell of an explant with an expression construct comprising a nucleotide sequence encoding a WUS/WOX homeobox polypeptide; and (b) allowing expression of the polypeptide of (a) in each transformed cell to form a regenerable plant structure in the absence of exogenous cytokinin, wherein no callus is formed; and (c) germinating the regenerable plant structure to form the transgenic plant.

In an aspect, the present disclosure comprises methods for producing a transgenic plant, comprising (a) transforming one or more cells of an explant with an expression construct comprising a nucleotide sequence encoding a polypeptide comprising two AP2-DNA binding domains; and (b) allowing expression of the polypeptide of (a) in each transformed cell to form a regenerable plant structure in the absence of exogenous cytokinin, wherein no callus is formed; and (c) germinating the regenerable plant structure to form the transgenic plant.

In an aspect, the present disclosure comprises methods for producing a transformed plant, comprising (a) transforming one or more cells of an explant with an expression construct comprising (i) a nucleotide sequence encoding a WUS/WOX homeobox polypeptide; and (ii) a nucleotide sequence encoding a polypeptide comprising two AP2-DNA binding domains; and (b) allowing expression of the polypeptides of (a) in each transformed cell to form a regenerable plant structure in the absence of exogenous cytokinin, wherein no callus is formed; and (c) germinating the regenerable plant structure to form the transgenic plant.

In an aspect, the present disclosure comprises methods for producing a transformed plant, comprising (a) transforming a cell of an explant with an expression construct comprising: (i) a nucleotide sequence encoding a WUS/WOX homeobox polypeptide; (ii) a nucleotide sequence encoding a polypeptide comprising two AP2-DNA binding domains; or (iii) a combination of (i) and (ii); (b) allowing expression of the polypeptide of (a) in each transformed cell to form a regenerable plant structure in the absence of exogenous cytokinin, wherein no callus is formed; and (c) germinating the regenerable plant structure to form the transgenic plant in about 14 days to about 60 days.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in a plant or in a plant organ, tissue or cell culture.

The present disclosure also includes plants obtained by any of the disclosed methods or compositions herein.

In an aspect, the present disclosure comprises methods for producing a transgenic plant, comprising (a) transforming a cell of an explant with an expression construct comprising: (i) a nucleotide sequence encoding a WUS/WOX homeobox polypeptide; (ii) a nucleotide sequence encoding a polypeptide comprising two AP2-DNA binding domains; or (iii) a combination of (i) and (ii); (b) allowing expression of the polypeptide of (a) in each transformed cell to form a regenerable plant structure in the absence of exogenous cytokinin, wherein no callus is formed; and (c) germinating the regenerable plant structure to form the transgenic plant in about 14 days to about 60 days.

The present disclosure also includes seeds from a plant obtained by any of the disclosed methods or compositions herein.

In an aspect, the present disclosure comprises kits comprising: (a) an expression construct comprising (i) a nucleotide sequence encoding a WUS/WOX homeobox polypeptide; (ii) a nucleotide sequence encoding a polypeptide comprising two AP2-DNA binding domains; or (iii) a combination of (i) and (ii); and (b) instructions for obtaining a regenerable plant structure in the absence of exogenous cytokinin, wherein no callus is formed; and (c) instructions for germinating the regenerable plant structure to form the transgenic plant.

In an aspect, the present disclosure comprises kits comprising (a) an expression construct comprising a nucleotide sequence encoding a WUS/WOX homeobox polypeptide; and (b) instructions for obtaining a regenerable plant structure in the absence of exogenous cytokinin, wherein no callus is formed; and (c) instructions for germinating the regenerable plant structure to form the transgenic plant.

In an aspect, the present disclosure comprises kits comprising (a) an expression construct comprising a nucleotide sequence encoding a polypeptide comprising two AP2-DNA binding domains; and (b) instructions for obtaining a regenerable plant structure in the absence of exogenous cytokinin, wherein no callus is formed; and (c) instructions for germinating the regenerable plant structure to form the transgenic plant.

The disclosed kits can further comprise instructions for germinating the regenerable plant structure to form the transgenic plant within about 14 days to about 60 days after transformation of the explant.

II. AP2-DNA Binding Domain Proteins (ODP2/BBM)

The methods of the present disclosure comprise polynucleotide sequences and amino acid sequences of Ovule Development Protein 2 (ODP2) polypeptides, and related polypeptides, e.g., Babyboom (BBM) protein family proteins. In an aspect, the polypeptide comprising the two AP2-DNA binding domains is an ODP2, BBM2, BMN2, or BMN3 polypeptide. The ODP2 polypeptides of the disclosure contain two predicted APETALA2 (AP2) domains and are members of the AP2 protein family (PFAM Accession PF00847). The AP2 domains of the maize ODP2 polypeptide are located from about amino acids S273 to N343 and from about S375 to R437 of SEQ ID NO:2). The AP2 family of putative transcription factors has been shown to regulate a wide range of developmental processes, and the family members are characterized by the presence of an AP2 DNA binding domain. This conserved core is predicted to form an amphipathic alpha helix that binds DNA. The AP2 domain was first identified in APETALA2, an *Arabidopsis* protein that regulates meristem identity, floral organ specification, seed coat development, and floral homeotic gene expression. The AP2 domain has now been found in a variety of proteins.

The ODP2 polypeptides of the disclosure share homology with several polypeptides within the AP2 family, e.g., see FIG. 1 of U.S. Pat. No. 8,420,893, which is incorporated herein by reference in its entirety, provides an alignment of the maize and rice ODP2 polypeptides with eight other proteins having two AP2 domains. A consensus sequence of all proteins appearing in the alignment of U.S. Pat. No. 8,420,893 is also provided in FIG. 1 therein.

The polypeptide comprising the two AP2-DNA binding domains can be derived from a monocot. In various aspects, the polypeptide comprising the two AP2-DNA binding domains is derived from barley, maize, millet, oats, rice, rye, *Setaria* sp., sorghum, sugarcane, switchgrass, triticale, turfgrass, or wheat. In an aspect, the polypeptide comprising the two AP2-DNA binding domains is derived from maize, barley, oats, rye, sugarcane, millet, sorghum, wheat, *Setaria* sp., or rice. In a further aspect, the monocot is maize, sorghum, rice, or *Setaria* sp. In a still further aspect, the monocot is maize or rice. In a further aspect, the monocot is maize. In a further aspect, the monocot is rice.

The polypeptide comprising the two AP2-DNA binding domains can be derived from a dicot. The polypeptide comprising the two AP2-DNA binding domains can be derived from kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton.

The polypeptide comprising the two AP2-DNA binding domains can be derived from a plant that is a member of the family Poaceae. Non-limiting examples of suitable plants from which the two AP2-DNA binding domains can be derived include grain crops, including, but not limited to, barley, maize (corn), oats, rice, rye, sorghum, wheat, millet, triticale; leaf and stem crops, including, but not limited to, bamboo, marram grass, meadow-grass, reeds, ryegrass, sugarcane; lawn grasses, ornamental grasses, and other grasses such as switchgrass and turfgrass.

In a further aspect, the polypeptide comprising the two AP2-DNA binding domains used in the disclosed methods can be derived from any plant, including higher plants, e.g., classes of Angiospermae and Gymnospermae. Plants of the subclasses of the Dicotylodenae and the Monocotyledonae are suitable. Suitable species may come from the family Acanthaceae, Alliaceae, Alstroemeriaceae, Amaryllidaceae, Apocynaceae, Arecaceae, Asteraceae, Berberidaceae, Bixaceae, Bras sicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, and Vitaceae.

Suitable species from which the polypeptide comprising the two AP2-DNA binding domains can be derived include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina,*

*Spinacea, Tanacetum, Taxus, Theobroma, Triticosecale, Triticum, Uniola, Veratrum, Vinca, Vitis,* and *Zea.*

In a further aspect, the polypeptide comprising the two AP2-DNA binding domains can be derived from a plant that is important or interesting for agriculture, horticulture, biomass for the production of liquid fuel molecules and other chemicals, and/or forestry. Non-limiting examples include, for instance, *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Arundo donax* (giant reed), *Secale cereale* (rye), *Salix* spp. (willow), *Eucalyptus* spp. (eucalyptus), *Triticosecale* spp. (*triticum*—wheat×rye), Bamboo, *Carthamus tinctorius* (safflower), *Jatropha curcas* (jatropha), *Ricinus communis* (castor), *Elaeis guineensis* (palm), *Linum usitatissimum* (flax), *Brassica juncea, Manihot esculenta* (cassava), *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum* (=*Huperzia serrata*), *Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (petunia), *Poinsettia pulcherrima* (poinsettia), *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass), *Phleum pratense* (timothy), and conifers. Of interest are plants grown for energy production, so called energy crops, such as cellulose-based energy crops like *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed), *Secale cereale* (rye), *Salix* spp. (willow), *Eucalyptus* spp. (eucalyptus), *Triticosecale* spp. (*triticum*—wheat×rye), and Bamboo; and starch-based energy crops like *Zea mays* (corn) and *Manihot esculenta* (cassava); and sucrose-based energy crops like *Saccharum* sp. (sugarcane) and *Beta vulgaris* (sugarbeet); and biodiesel-producing energy crops like *Glycine max* (soybean), *Brassica napus* (canola), *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea.*

The polypeptide comprising the two AP2-DNA binding domains can be derived from a biomass renewable energy source plant. Examples of biomass renewable energy source plants include those described herein above.

In particular, the present disclosure provides for isolated nucleic acid molecules comprising nucleotide sequences encoding the amino acid sequences shown in SEQ ID NO: 18, 20, 63, 65, and 67. Further provided are polypeptides having an amino acid sequence encoded by a nucleic acid molecule (SEQ ID NO: 17, 19, 21, 62, 64, 66, and 68) described herein, and fragments and variants thereof.

In an aspect, the polypeptide comprising the two AP2-DNA binding domains is an ODP2 polypeptide. In a further aspect, the ODP2 polypeptide is derived from a monocot polypeptide. In particular aspects, the ODP2 polypeptide is derived from maize, barley, oats, rye, sugarcane, millet, sorghum, wheat, *Setaria* sp., or rice. In an aspect, the ODP2 polypeptide is derived from maize, rice, or *Setaria* sp. In an aspect, the ODP2 polypeptide is derived from maize or rice. In a particular aspect, the ODP2 polypeptide is derived from maize. In a particular aspect, the ODP2 polypeptide is derived from rice. In a further aspect, the ODP2 polypeptide is derived from a dicot polypeptide. In particular aspects, the ODP2 polypeptide is derived from kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. The ODP2 polypeptide expressed by the expression construct of the disclosed methods and compositions can be the polypeptide comprising SEQ ID NO: 18, 63, 65, or 67. The ODP2 polypeptide can be encoded by the polynucleotide of SEQ ID NO: 17, 21, 62, 64, 66, or 68.

In an aspect, the polypeptide comprising the two AP2-DNA binding domains is a BBM2 polypeptide. The BBM2 polypeptide can be a monocot polypeptide, including, but not limited to such monocots as maize, barley, oats, rye, sugarcane, millet, sorghum, wheat, *Setaria* sp., or rice. In particular aspects, the monocot is maize, sugarcane, rice, or *Setaria* sp. In a further particular aspect, the monocot is maize or rice. In a still further particular aspect, the monocot is maize. Alternatively, the BBM2 polypeptide can be a dicot polypeptide, including, but not limited to, wherein the dicot is kale, cauliflower, broccoli, mustard plant, cabbage, pea, clover, alfalfa, broad bean, tomato, cassava, soybean, canola, alfalfa, sunflower, safflower, tobacco, *Arabidopsis*, or cotton. In one aspect, the BBM2 polypeptide comprises the amino acid sequence of SEQ ID NO:20. In a further aspect, the BBM2 polypeptide is encoded by a nucleotide sequence comprising the sequence of SEQ ID NO:19.

The present disclosure encompasses isolated or substantially purified nucleic acid or protein ODP2/BBM compositions. An "isolated" or "purified" nucleic acid molecule or protein, or biologically active portion thereof, is substantially or essentially free from components that normally accompany or interact with the nucleic acid molecule or protein as found in its naturally occurring environment. Thus, an isolated or purified nucleic acid molecule or protein is substantially free of other cellular material or culture medium when produced by recombinant techniques, or substantially free of chemical precursors or other chemicals when chemically synthesized. Optimally, an "isolated" nucleic acid is free of sequences (optimally protein encoding sequences) that naturally flank the nucleic acid (i.e., sequences located at the 5' and 3' ends of the nucleic acid) in the genomic DNA of the organism from which the nucleic acid is derived. For example, in various aspects, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein that is substantially free of cellular material includes preparations of protein having less than about 30%, 20%, 10%, 5%, or 1% (by dry weight) of contaminating protein. When the protein of the disclosure or biologically active portion thereof is recombinantly produced, optimally culture medium represents less than about 30%, 20%, 10%, 5%, or 1% (by dry weight) of chemical precursors or non-protein-of-interest chemicals.

Fragments and variants of the disclosed nucleotide sequences and proteins encoded thereby are also encompassed by the present disclosure. By "fragment" is intended a portion of the nucleotide sequence or a portion of the amino acid sequence and hence protein encoded thereby. Fragments of a nucleotide sequence may encode protein fragments that retain the biological activity of the native protein and hence have ODP2 activity. Alternatively, fragments of a nucleotide sequence useful as hybridization probes generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the disclosure.

By "ODP2 activity" or "Ovule Development Protein 2 activity" is intended the ODP2 polypeptide has at least one of the following exemplary activities: increases the regenerative capability of a plant cell; renders the plant cell embryogenic; increases the transformation efficiencies of a plant cell; alters the oil content of a plant cell; binds DNA; increases abiotic stress tolerance; increases or maintains yield under abiotic stress; increases asexual embryo formation; alters starch content; alters embryo size or activates transcription. Methods to assay for such activity are known in the art and are described more fully below.

A fragment of an ODP2/BBM nucleotide sequence that encodes a biologically active portion of an ODP2/BBM protein of the disclosure will encode at least 15, 25, 30, 50, 100, 150, 200, 250, 300, 350, 400, 450, 500, 550, 600, 650, 700, 709 contiguous amino acids, or up to the total number of amino acids present in a full-length ODP2/BBM protein of the disclosure. Fragments of an ODP2 nucleotide sequence that are useful as hybridization probes or PCR primers generally need not encode a biologically active portion of an ODP2/BBM protein.

Thus, a fragment of an ODP2/BBM nucleotide sequence may encode a biologically active portion of an ODP2/BBM protein, or it may be a fragment that can be used as a hybridization probe or PCR primer using methods disclosed below. A biologically active portion of an ODP2/BBM protein can be prepared by isolating a portion of one of the ODP2/BBM nucleotide sequences of the disclosure, expressing the encoded portion of the ODP2/BBM protein (e.g., by recombinant expression in vitro), and assessing the activity of the encoded portion of the ODP2/BBM protein. Nucleic acid molecules that are fragments of an ODP2/BBM nucleotide sequence comprise at least 16, 20, 50, 75, 100, 150, 200, 250, 300, 350, 400, 450, 500, 550, 600, 650, 700, 800, 900, 1,000, 1,100, 1,200, 1,300, or 1,400, 1,500, 1,600, 1,700, 1,800, 1,900, 2,000, 2,100, 2,200 contiguous nucleotides, or up to the number of nucleotides present in a full-length ODP2/BBM nucleotide sequence disclosed herein (for example, SEQ ID NOS:17, 19, and 21).

"Variants" is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a "native" polynucleotide or polypeptide comprises a naturally occurring nucleotide sequence or amino acid sequence, respectively. For polynucleotides, conservative variants include those sequences that, because of the degeneracy of the genetic code, encode the amino acid sequence of one of the ODP2/BBM polypeptides of the disclosure. Variant ODP2/BBM2 polynucleotides also include synthetically derived polynucleotides, such as those generated, for example, by using site-directed mutagenesis but which still encode an ODP2 protein of the disclosure. Generally, variants of a particular polynucleotide of the disclosure will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

"Variant" protein is intended to mean a protein derived from the native protein by deletion or addition of one or more amino acids at one or more internal sites in the native protein and/or substitution of one or more amino acids at one or more sites in the native protein. Variant proteins encompassed by the present disclosure are biologically active, that is they continue to possess the desired biological activity of the native protein, that is, the polypeptide has ODP2/BBM activity (i.e., modulating the regenerative capability of a plant, rendering the plant embryogenic, increasing the transformation efficiency of a plant, altering oil content of a plant, increasing cell proliferation, increasing abiotic stress tolerance, increasing or maintaining yield under abiotic stress, modifying starch content, increasing asexual embryo formation, binding DNA or regulating transcription) as described herein. Such variants may result from, for example, genetic polymorphism or from human manipulation. Biologically active variants of a native ODP2/BBM protein of the disclosure will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the native protein as determined by sequence alignment programs and parameters described elsewhere herein. A biologically active variant of a protein of the disclosure may differ from that protein by as few as 1-15 amino acid residues, as few as 1-10, such as 6-10, as few as 5, as few as 4, 3, 2, or even 1 amino acid residue.

The ODP2/BBM proteins of the disclosure may be altered in various ways including amino acid substitutions, deletions, truncations, fusions, and insertions. Methods for such manipulations are generally known in the art. For example, amino acid sequence variants of the ODP2 proteins can be prepared by mutations in the DNA. Methods for mutagenesis and nucleotide sequence alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (Mac-Millan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be optimal.

III. WUS/WOX Homeobox Polypeptides

The methods of the present disclosure comprise polynucleotide sequences and amino acid sequences of WUS/WOX homeobox polypeptides. The Wuschel protein, designated hereafter as WUS, plays a key role in the initiation and maintenance of the apical meristem, which contains a pool of pluripotent stem cells (Endrizzi, et al., (1996) Plant Journal 10:967-979; Laux, et al., (1996) Development 122: 87-96; and Mayer, et al., (1998) Cell 95:805-815). *Arabidopsis* plants mutant for the WUS gene contain stem cells that are misspecified and that appear to undergo differentiation. WUS encodes a novel homeodomain protein which presumably functions as a transcriptional regulator (Mayer, et al., (1998) Cell 95:805-815). The stem cell population of *Arabidopsis* shoot meristems is believed to be maintained by a regulatory loop between the CLAVATA (CLV) genes which promote organ initiation and the WUS gene which is required for stem cell identity, with the CLV genes repressing WUS at the transcript level, and WUS expression being sufficient to induce meristem cell identity and the expression of the stem cell marker CLV3 (Brand, et al., (2000) Science 289:617-619; Schoof, et al., (2000) Cell 100:635-644). Constitutive expression of WUS in *Arabidopsis* has been shown to lead to adventitious shoot proliferation from leaves (in planta) (Laux, T., Talk Presented at the XVI International Botanical Congress Meeting, Aug. 1-7, 1999, St. Louis, Mo.).

In an aspect, the WUS/WOX homeobox polypeptide is a WUS1, WUS2, WUS3, WOX2A, WOX4, WOX5, or WOX9 polypeptide (van der Graaff et al., 2009, Genome Biology 10:248). The WUS/WOX homeobox polypeptide can be a monocot WUS/WOX homeobox polypeptide. In various aspects, WUS/WOX homeobox polypeptide can be a barley, maize, millet, oats, rice, rye, *Setaria* sp., sorghum, sugarcane, switchgrass, triticale, turfgrass, or wheat WUS/WOX homeobox polypeptide. Alternatively, the WUS/WOX homeobox polypeptide can be a dicot WUS/WOX homeobox polypeptide. In particular, the present disclosure provides for isolated nucleic acid molecules comprising nucleotide sequences encoding the amino acid sequences shown in SEQ ID NOS: 4, 6, 8, 10, 12, 14, and 16. Further provided are polypeptides having an amino acid sequence encoded by a nucleic acid molecule (SEQ ID NO: 3, 5, 7, 9, 11, 13, and 15) described herein, and fragments and variants thereof.

The WUS/WOX homeobox polypeptide can be derived from a plant that is a member of the family Poaceae. Non-limiting examples of suitable plants from which the WUS/WOX homeobox polypeptide can be derived include grain crops, including, but not limited to, barley, maize (corn), oats, rice, rye, sorghum, wheat, millet, triticale; leaf and stem crops, including, but not limited to, bamboo, marram grass, meadow-grass, reeds, ryegrass, sugarcane; lawn grasses, ornamental grasses, and other grasses such as switchgrass and turfgrass.

In a further aspect, the WUS/WOX homeobox polypeptide used in the disclosed methods can be derived from any plant, including higher plants, e.g., classes of Angiospermae and Gymnospermae. Plants of the subclasses of the Dicotylodenae and the Monocotyledonae are suitable. Suitable species may come from the family Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, and Vitaceae.

Suitable species from which the WUS/WOX homeobox polypeptide can be derived include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

In a further aspect, the WUS/WOX homeobox polypeptide can be derived from a plant that is important or interesting for agriculture, horticulture, biomass for the production of liquid fuel molecules and other chemicals, and/or forestry. Non-limiting examples include, for instance, *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Arundo donax* (giant reed), *Secale cereale* (rye), *Salix* spp. (willow), *Eucalyptus* spp. (*eucalyptus*), *Triticosecale* spp. (*triticum*—wheat×rye), Bamboo, *Carthamus tinctorius* (safflower), *Jatropha curcas* (*jatropha*), *Ricinus communis* (castor), *Elaeis guineensis* (palm), *Linum usitatissimum* (flax), *Brassica juncea, Manihot esculenta* (cassava), *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), Theobroma cacao (cocoa), Coffea arabica (coffee), Vitis vinifera (grape), Ananas comosus (pineapple), Capsicum annum (hot & sweet pepper), Allium cepa (onion), Cucumis melo (melon), Cucumis sativus (cucumber), Cucurbita maxima (squash), Cucurbita moschata (squash), Spinacea oleracea (spinach), Citrullus lanatus (watermelon), Abelmoschus esculentus (okra), Solanum melongena (eggplant), Papaver somniferum (opium poppy), Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica., Digitalis lanata, Digitalis purpurea, Dioscorea spp., Andrographis paniculata, Atropa belladonna, Datura stomonium, Berberis spp., Cephalotaxus spp., Ephedra sinica, Ephedra spp., Erythroxylum coca, Galanthus wornorii, Scopolia spp., Lycopodium serratum (=Huperzia serrata), Lycopodium spp., Rauwolfia serpentina, Rauwolfia spp., Sanguinaria canadensis, Hyoscyamus spp., Calendula officinalis, Chrysanthemum parthenium, Coleus forskohlii, Tanacetum parthenium, Parthenium argentatum (guayule), Hevea spp. (rubber), Mentha spicata (mint), Mentha piperita (mint), Bixa orellana, Alstroemeria spp., Rosa spp. (rose), Dianthus caryophyllus (carnation), Petunia spp. (petunia), Poinsettia pulcherrima (poinsettia), Nicotiana tabacum (tobacco), Lupinus albus (lupin), Uniola paniculata (oats), bentgrass (Agrostis spp.), Populus tremuloides (aspen), Pinus spp. (pine), Abies spp. (fir), Acer spp. (maple), Hordeum vulgare (barley), Poa pratensis (bluegrass), Lolium spp. (ryegrass), Phleum pratense (timothy), and conifers. Of interest are plants grown for energy production, so called energy crops, such as cellulose-based energy crops like Panicum virgatum (switchgrass), Sorghum bicolor (sorghum, sudangrass), Miscanthus giganteus (miscanthus), Saccharum sp. (energycane), Populus balsamifera (poplar), Andropogon gerardii (big bluestem), Pennisetum purpureum (elephant grass), Phalaris arundinacea (reed canarygrass), Cynodon dactylon (bermudagrass), Festuca arundinacea (tall fescue), Spartina pectinata (prairie cordgrass), Medicago sativa (alfalfa), Arundo donax (giant reed), Secale cereale (rye), Salix spp. (willow), Eucalyptus spp. (eucalyptus), Triticosecale spp. (triticum—wheat×rye), and Bamboo; and starch-based energy crops like Zea mays (corn) and Manihot esculenta (cassava); and sucrose-based energy crops like Saccharum sp. (sugarcane) and Beta vulgaris (sugarbeet); and biodiesel-producing energy crops like Glycine max (soybean), Brassica napus (canola), Helianthus annuus (sunflower), Carthamus tinctorius (safflower), Jatropha curcas (jatropha), Ricinus communis (castor), Elaeis guineensis (palm), Linum usitatissimum (flax), and Brassica juncea.

The WUS/WOX homeobox polypeptide can be derived from a biomass renewable energy source. Examples of biomass renewable energy source plants include those described herein above.

The WUS/WOX homeobox polypeptide used in the disclosed methods and compositions can be a WUS1 polypeptide. In an aspect, The WUS1 polypeptide is a maize, sorghum, rice or Setaria sp. WUS1 polypeptide. In a further aspect, the WUS1 polypeptide is a maize or rice WUS1 polypeptide. In a further aspect, the WUS1 polypeptide is a maize WUS1 polypeptide. In particular, the WUS1 polypeptide comprises an amino acid sequence of SEQ ID NO:4 or the WUS1 polypeptide is encoded by a nucleotide sequence comprising SEQ ID NO:3.

The WUS/WOX homeobox polypeptide used in the disclosed methods and compositions can be a WUS2 polypeptide. In various aspects, the WUS2 polypeptide is a barley, maize, millet, oats, rice, rye, *Setaria* sp., sorghum, sugarcane, switchgrass, triticale, turfgrass, or wheat WUS polypeptide. In an aspect, the WUS2 polypeptide is a maize, sorghum, rice or *Setaria* sp. WUS2 polypeptide. In a further aspect, the WUS2 polypeptide is a maize or rice WUS2 polypeptide. In a further aspect, the WUS2 polypeptide is a maize WUS2 polypeptide. In particular, the WUS2 polypeptide comprises an amino acid sequence of SEQ ID NO:6 or the WUS2 polypeptide is encoded by a nucleotide sequence comprising SEQ ID NO:5.

The WUS/WOX homeobox polypeptide used in the disclosed methods and compositions can be a WUS3 polypeptide. In an aspect, The WUS3 polypeptide is a maize, sorghum, rice or *Setaria* sp. WUS3 polypeptide. In a further aspect, the WUS3 polypeptide is a maize or rice WUS3 polypeptide. In a further aspect, the WUS3 polypeptide is a maize WUS3 polypeptide. In particular, the WUS3 polypeptide comprises an amino acid sequence of SEQ ID NO:8 or the WUS3 polypeptide is encoded by a nucleotide sequence comprising SEQ ID NO:7.

The WUS/WOX homeobox polypeptide used in the disclosed methods and compositions can be a WOX2A polypeptide. In an aspect, The WOX2A polypeptide is a maize, sorghum, rice or *Setaria* sp. WOX2A polypeptide. In a further aspect, the WOX2A polypeptide is a maize or rice WUS2A polypeptide. In a further aspect, the WOX2A polypeptide is a maize WOX2A polypeptide. In particular, the WOX2A polypeptide comprises an amino acid sequence of SEQ ID NO:10 or the WOX2A polypeptide is encoded by a nucleotide sequence comprising SEQ ID NO:9.

The WUS/WOX homeobox polypeptide used in the disclosed methods and compositions can be a WOX4 polypeptide. In an aspect, The WOX4 polypeptide is a maize, sorghum, rice or *Setaria* sp. WOX4 polypeptide. In a further aspect, the WOX4 polypeptide is a maize or rice WUS4 polypeptide. In a further aspect, the WOX4 polypeptide is a maize WOX4 polypeptide. In particular, the WOX4 polypeptide comprises an amino acid sequence of SEQ ID NO:12 or the WOX4 polypeptide is encoded by a nucleotide sequence comprising SEQ ID NO:11.

The WUS/WOX homeobox polypeptide used in the disclosed methods and compositions can be a WOX5A polypeptide. In an aspect, The WOX5A polypeptide is a maize, sorghum, rice or *Setaria* sp. WOX5A polypeptide. In a further aspect, the WOX5A polypeptide is a maize or rice WUS5A polypeptide. In a further aspect, the WOX5A polypeptide is a maize WOX5A polypeptide. In particular, the WOX5A polypeptide comprises an amino acid sequence of SEQ ID NO:14 or the WOX5A polypeptide is encoded by a nucleotide sequence comprising SEQ ID NO:13.

The WUS/WOX homeobox polypeptide used in the disclosed methods and compositions can be a WOX9 polypeptide. In an aspect, The WOX9 polypeptide is a maize, sorghum, rice or *Setaria* sp. WOX9 polypeptide. In a further aspect, the WOX9 polypeptide is a maize or rice WUS9 polypeptide. In a further aspect, the WOX9 polypeptide is a maize WOX9 polypeptide. In particular, the WOX9 polypeptide comprises an amino acid sequence of SEQ ID NO:16 or the WOX9 polypeptide is encoded by a nucleotide sequence comprising SEQ ID NO:15.

The present disclosure encompasses isolated or substantially purified nucleic acid or protein WUS/WOX compositions. Fragments and variants of the WUS/WOX nucleotide sequences and proteins encoded thereby are also encompassed by the present disclosure. By "fragment" is intended a portion of the nucleotide sequence or a portion of the amino acid sequence and hence protein encoded thereby.

Fragments of a nucleotide sequence may encode protein fragments that retain the biological activity of the native protein and hence have WUS/WOX activity. Alternatively, fragments of a nucleotide sequence useful as hybridization probes generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the disclosure.

A fragment of a WUS/WOX nucleotide sequence that encodes a biologically active portion of a WUS/WOX protein of the disclosure will encode at least 15, 25, 30, 50, 100, 150, 200, 250, 300, 350, 400, 450, 500, 550, 600, 650, 700, 709 contiguous amino acids, or up to the total number of amino acids present in a full-length WUS/WOX protein of the disclosure. Fragments of a WUS/WOX nucleotide sequence useful as hybridization probes or PCR primers generally need not encode a biologically active portion of a WUS/WOX protein.

Thus, a fragment of a WUS/WOX nucleotide sequence may encode a biologically active portion of a WUS/WOX protein, or it may be a fragment that can be used as a hybridization probe or PCR primer using methods disclosed below. A biologically active portion of a WUS/WOX protein can be prepared by isolating a portion of one of the WUS/WOX nucleotide sequences of the disclosure, expressing the encoded portion of the WUX/WOX protein (e.g., by recombinant expression in vitro), and assessing the activity of the encoded portion of the WUS/WOX protein. Nucleic acid molecules that are fragments of a WUS/WOX nucleotide sequence comprise at least 16, 20, 50, 75, 100, 150, 200, 250, 300, 350, 400, 450, 500, 550, 600, 650, 700, 800, 900, 1,000, 1,100, 1,200, 1,300, or 1,400, 1,500, 1,600, 1,700, 1,800, 1,900, 2,000, 2,100, 2,200 contiguous nucleotides, or up to the number of nucleotides present in a full-length WUS/WOX nucleotide sequence disclosed herein (for example, SEQ ID NOS: 3, 5, 7, 9, 11, 13, and 15).

"Variants" is intended to mean substantially similar sequences. For polynucleotides, conservative variants include those sequences that, because of the degeneracy of the genetic code, encode the amino acid sequence of one of the WUS/WOX polypeptides of the disclosure. Variant polynucleotides also include synthetically derived polynucleotides, such as those generated, for example, by using site-directed mutagenesis but which still encode a WUS/WOX protein of the disclosure. Generally, variants of a particular polynucleotide of the disclosure will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

"Variant" protein is intended to mean a protein derived from the native protein by deletion or addition of one or more amino acids at one or more internal sites in the native protein and/or substitution of one or more amino acids at one or more sites in the native protein. Variant proteins encompassed by the present disclosure are biologically active, that is they continue to possess the desired biological activity of the native protein, that is, the polypeptide has WUS/WOX activity. Such variants may result from, for example, genetic polymorphism or from human manipulation. Biologically active variants of a native WUS/WOX protein of the disclosure will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the native protein as determined by sequence alignment programs and parameters described elsewhere herein. A biologically active variant of a protein of the disclosure may differ from that protein by as few as 1-15 amino acid residues, as few as 1-10, such as 6-10, as few as 5, as few as 4, 3, 2, or even 1 amino acid residue.

The WUS/WOX proteins of the disclosure may be altered in various ways including amino acid substitutions, deletions, truncations, and insertions. Methods for such manipulations are generally known in the art. For example, amino acid sequence variants of the WUS/WOX proteins can be prepared by mutations in the DNA. Methods for mutagenesis and nucleotide sequence alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be optimal.

IV. Transformation Methods

The methods and composition of the disclosure can utilize a variety of transformation methods as appropriate. That is, transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (Townsend et al., U.S. Pat. No. 5,563,055; Zhao et al., U.S. Pat. No. 5,981,840), direct gene transfer (Paszkowski et al. (1984) *EMBO J.* 3:2717-2722), and ballistic particle acceleration (see, for example, Sanford et al., U.S. Pat. No. 4,945,050; Tomes et al., U.S. Pat. No. 5,879,918; Tomes et al., U.S. Pat. No. 5,886,244; Bidney et al., U.S. Pat. No. 5,932,782; Tomes et al. (1995) "Direct DNA Transfer into Intact Plant Cells via Microprojectile Bombardment," in *Plant Cell, Tissue, and Organ Culture: Fundamental Methods*, ed. Gamborg and Phillips (Springer-Verlag, Berlin); and McCabe et al. (1988) *Biotechnology* 6:923-926). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); Tomes, U.S. Pat. No. 5,240,855; Buising et al., U.S. Pat. Nos. 5,322,783 and 5,324,646; Tomes et al. (1995) "Direct DNA Transfer into Intact Plant Cells via Microprojectile Bombardment," in *Plant Cell, Tissue, and Organ Culture: Fundamental Methods*, ed. Gamborg (Springer-Verlag, Berlin) (maize); Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; Bowen et al., U.S. Pat. No. 5,736,369 (cereals); Bytebier et al. (1987) *Proc.*

*Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

The methods and composition of the present disclosure may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum.

Conifers that may be employed in practicing the present disclosure include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Eastern or Canadian hemlock (*Tsuga canadensis*); Western hemlock (*Tsuga heterophylla*); Mountain hemlock (*Tsuga mertensiana*); Tamarack or Larch (*Larix occidentalis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). *Eucalyptus* species may be employed in practicing the present disclosure, including *E. grandis* (and its hybrids, as "urograndis"), *E. globulus, E. camaldulensis, E. tereticornis, E. viminalis, E. nitens, E. saligna* and *E. urophylla*. Optimally, plants of the present disclosure are crop plants (for example, corn, alfalfa, sunflower, *Brassica*, soybean, cotton, safflower, peanut, sorghum, wheat, millet, tobacco, etc.), more optimally corn and soybean plants, yet more optimally corn plants.

Plants of particular interest include grain plants that provide seeds of interest, oil-seed plants, and leguminous plants. Seeds of interest include grain seeds, such as corn, wheat, barley, rice, sorghum, rye, etc. Oil-seed plants include cotton, soybean, safflower, sunflower, *Brassica*, maize, alfalfa, palm, coconut, etc. Leguminous plants include, but are not limited to, beans and peas. Beans include, but are not limited to, guar, locust bean, fenugreek, soybean, garden beans, cowpea, mungbean, lima bean, fava bean, lentils, and chickpea.

A selectable marker comprises a DNA segment that allows one to identify or select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions and the like. Examples of selectable markers include, but are not limited to, DNA segments that comprise restriction enzyme sites; DNA segments that encode products which provide resistance against otherwise toxic compounds (e.g., antibiotics, such as, spectinomycin, ampicillin, kanamycin, tetracycline, Basta, neomycin phosphotransferase II (NEO) and hygromycin phosphotransferase (HPT)); DNA segments that encode products which are otherwise lacking in the recipient cell (e.g., tRNA genes, auxotrophic markers); DNA segments that encode products which can be readily identified (e.g., phenotypic markers such as β-galactosidase, GUS; fluorescent proteins such as green fluorescent protein (GFP), cyan (CFP), yellow (YFP), red (RFP), and cell surface proteins); the generation of new primer sites for PCR (e.g., the juxtaposition of two DNA sequence not previously juxtaposed), the inclusion of DNA sequences not acted upon or acted upon by a restriction endonuclease or other DNA modifying enzyme, chemical, etc.; and, the inclusion of a DNA sequences required for a specific modification (e.g., methylation) that allows its identification.

Additional selectable markers include genes that confer resistance to herbicidal compounds, such as glyphosate, sulfonylureas, glufosinate ammonium, bromoxynil, imidazolinones, and 2,4-dichlorophenoxyacetate (2,4-D). See generally, Yarranton (1992) *Curr. Opin. Biotech.* 3:506-511; Christopherson et al. (1992) *Proc. Natl. Acad. Sci. USA* 89:6314-6318; Yao et al. (1992) *Cell* 71:63-72; Reznikoff (1992) *Mol. Microbiol.* 6:2419-2422; Barkley et al. (1980) in *The Operon*, pp. 177-220; Hu et al. (1987) *Cell* 48:555-566; Brown et al. (1987) *Cell* 49:603-612; Figge et al. (1988) *Cell* 52:713-722; Deuschle et al. (1989) *Proc. Natl. Acad. Sci. USA* 86:5400-5404; Fuerst et al. (1989) *Proc. Natl. Acad. Sci. USA* 86:2549-2553; Deuschle et al. (1990) *Science* 248:480-483; Gossen (1993) Ph.D. Thesis, University of Heidelberg; Reines et al. (1993) *Proc. Natl. Acad. Sci. USA* 90:1917-1921; Labow et al. (1990) *Mol. Cell. Biol.* 10:3343-3356; Zambretti et al. (1992) *Proc. Natl. Acad. Sci. USA* 89:3952-3956; Bairn et al. (1991) *Proc. Natl. Acad. Sci. USA* 88:5072-5076; Wyborski et al. (1991) *Nucleic Acids Res.* 19:4647-4653; Hillen and Wissman (1989) *Topics Mol. Struc. Biol.* 10:143-162; Degenkolb et al. (1991) *Antimicrob. Agents Chemother.* 35:1591-1595; Kleinschnidt et al. (1988) *Biochemistry* 27:1094-1104; Bonin (1993) Ph.D. Thesis, University of Heidelberg; Gossen et al. (1992) *Proc. Natl. Acad. Sci. USA* 89:5547-5551; Oliva et al. (1992) *Antimicrob. Agents Chemother.* 36:913-919; Hlavka et al. (1985) *Handbook of Experimental Pharmacology*, Vol. 78

(Springer-Verlag, Berlin); Gill et al. (1988) *Nature* 334:721-724. Such disclosures are herein incorporated by reference. The above list of selectable markers is not meant to be limiting. Any selectable marker can be used in the methods and compositions.

Because the timeframe of somatic embryogenesis and embryo maturation for the described method is so truncated, the selection regime accordingly must occur rapidly in order to effectively eliminate non-transgenic embryos and the resultant germinated T0 plants. As a result, depending on the stringency of the selective agent over short timeframes, the percentage of recovered "escapes" (or regenerated T0 plants that are wild-type) increase. To eliminate escapes, traditional in vitro selection of transgenic events in cereals has occurred over a timeframe of 1.5 to 3 months with multiple subcultures on selection medium being required to amass enough callus tissue for regeneration (Gordon-Kamm et al., 1990, Plant Cell 2:603-618; Negrotto et al., 2000, Plant Cell Reports; Zhao et al., 2001, Mol. Breed. 8, 323-333; Wu et al., 2014, In Vitro Cell. Dev. Biol. 50:9-18; see Kan Wang, 2014, *Agrobacterium* Protocols, Vol. 1, third edition, Springer-Verlag, New York for review). The present disclosure eliminates much of this long-duration selection by eliminating callus culture and instead progressing directly through rapid embryogenesis and germination into independent T0 plants (each representing a separate integration event), requiring selective agents that work rapidly.

Certain selectable markers useful in the present method include, but are not limited to, the maize HRA gene (Lee et al., 1988, EMBO J 7:1241-1248) which confers resistance to sulfonylureas and imidazolinones, the GAT gene which confers resistance to glyphosate (Castle et al., 2004, Science 304:1151-1154), genes that confer resistance to spectinomycin such as the aadA gene (Svab et al., 1990, Plant Mol Biol. 14:197-205) and the bar gene that confers resistance to glufosinate ammonium (White et al., 1990, Nucl. Acids Res. 25:1062), and PAT (or moPAT for corn, see Rasco-Gaunt et al., 2003, Plant Cell Rep. 21:569-76) and the PMI gene that permits growth on mannose-containing medium (Negrotto et al., 2000, Plant Cell Rep. 22:684-690) are very useful for rapid selection during the brief elapsed time encompassed by somatic embryogenesis and embry maturation of the method. However, depending on the selectable marker used and the crop, inbred or variety being transformed, the percentage of wild-type escapes can vary. In maize and sorghum the HRA gene is efficacious in reducing the frequency of wild-type escapes.

V. Methods to Improve Plant Traits and Characteristics

The present disclosure provides novel compositions and methods for producing transgenic plants with increased efficiency and speed. The disclosed methods and compositions can further comprise polynucleotides that provide for improved traits and characteristics.

As used herein, "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring uptake of carbon dioxide, or by the observation of the expression level of a gene or genes, e.g., by employing Northern analysis, RT-PCR, microarray gene expression assays, or reporter gene expression systems, or by agricultural observations such as stress tolerance, yield, or pathogen tolerance. An "enhanced trait" as used in describing the aspects of the present disclosure includes improved or enhanced water use efficiency or drought tolerance, osmotic stress tolerance, high salinity stress tolerance, heat stress tolerance, enhanced cold tolerance, including cold germination tolerance, increased yield, enhanced nitrogen use efficiency, early plant growth and development, late plant growth and development, enhanced seed protein, and enhanced seed oil production.

Any polynucleotide of interest can be used in the methods of the disclosure. Various changes in phenotype are of interest including modifying the fatty acid composition in a plant, altering the amino acid content, starch content, or carbohydrate content of a plant, altering a plant's pathogen defense mechanism, affecting kernel size, sucrose loading, and the like. The gene of interest may also be involved in regulating the influx of nutrients, and in regulating expression of phytate genes particularly to lower phytate levels in the seed. These results can be achieved by providing expression of heterologous products or increased expression of endogenous products in plants. Alternatively, the results can be achieved by providing for a reduction of expression of one or more endogenous products, particularly enzymes or cofactors in the plant. These changes result in a change in phenotype of the transformed plant.

Genes of interest are reflective of the commercial markets and interests of those involved in the development of the crop. Crops and markets of interest change, and as developing nations open up world markets, new crops and technologies will emerge also. In addition, as our understanding of agronomic traits and characteristics such as yield and heterosis increase, the choice of genes for transformation will change accordingly. General categories of genes of interest include, for example, those genes involved in information, such as zinc fingers, those involved in communication, such as kinases, and those involved in housekeeping, such as heat shock proteins. More specific categories of transgenes, for example, include genes encoding important traits for agronomics, insect resistance, disease resistance, herbicide resistance, sterility, grain characteristics, and commercial products. Genes of interest include, generally, those involved in oil, starch, carbohydrate, or nutrient metabolism as well as those affecting kernel size, sucrose loading, and the like.

The polynucleotides introduced into an explant by the disclosed methods and compositions can be operably linked to a suitable promoter. "Promoter" means a region of DNA that is upstream from the start of transcription and is involved in recognition and binding of RNA polymerase and other proteins to initiate transcription, either including or not including the 5' UTR. A "plant promoter" is a promoter capable of initiating transcription in plant cells whether or not its origin is a plant cell. Exemplary plant promoters include, but are not limited to, those that are obtained from plants, plant viruses, and bacteria which comprise genes expressed in plant cells such as from *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissues are referred to as "tissue specific". A "cell type" specific promoter primarily drives expression in certain cell types in one or more organs, for example, vascular cells in roots or leaves. An "inducible" or "repressible" promoter can be a promoter which is under either environmental or exogenous control. Examples of environmental conditions that may effect transcription by inducible promoters include anaerobic conditions, or certain chemicals, or the presence of light.

Alternatively, exogenous control of an inducible or repressible promoter can be affected by providing a suitable chemical or other agent that via interaction with target polypeptides result in induction or repression of the promoter. Tissue specific, tissue preferred, cell type specific, and inducible promoters constitute the class of "non-constitutive" promoters. A "constitutive" promoter is a promoter which is active under most conditions. As used herein, "antisense orientation" includes reference to a polynucleotide sequence that is operably linked to a promoter in an orientation where the antisense strand is transcribed. The antisense strand is sufficiently complementary to an endogenous transcription product such that translation of the endogenous transcription product is often inhibited. "Operably linked" refers to the association of two or more nucleic acid fragments on a single nucleic acid fragment so that the function of one is affected by the other. For example, a promoter is operably linked with a coding sequence when it is capable of affecting the expression of that coding sequence (i.e., that the coding sequence is under the transcriptional control of the promoter). Coding sequences can be operably linked to regulatory sequences in sense or antisense orientation.

Agronomically important traits such as oil, starch, and protein content can be genetically altered in addition to using traditional breeding methods. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885,802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) *Eur. J. Biochem.* 165:99-106, the disclosures of which are herein incorporated by reference.

Derivatives of the coding sequences can be made by site-directed mutagenesis to increase the level of preselected amino acids in the encoded polypeptide. For example, methionine-rich plant proteins such as from sunflower seed (Lilley et al. (1989) Proceedings of the *World Congress on Vegetable Protein Utilization in Human Foods and Animal Feedstuffs*, ed. Applewhite (American Oil Chemists Society, Champaign, Ill.), pp. 497-502; herein incorporated by reference); corn (Pedersen et al. (1986) *J. Biol. Chem.* 261: 6279; Kirihara et al. (1988) *Gene* 71:359; both of which are herein incorporated by reference); and rice (Musumura et al. (1989) *Plant Mol. Biol.* 12:123, herein incorporated by reference) could be used. Other agronomically important genes encode latex, Floury 2, growth factors, seed storage factors, and transcription factors.

Insect resistance genes may encode resistance to pests that have great yield drag such as rootworm, cutworm, European Corn Borer, and the like. Such genes include, for example, *Bacillus thuringiensis* toxic protein genes (U.S. Pat. Nos. 5,366,892; 5,747,450; 5,736,514; 5,723,756; 5,593,881; and Geiser et al. (1986) *Gene* 48:109); and, the like.

Genes encoding disease resistance traits include detoxification genes, such as against fumonosin (U.S. Pat. No. 5,792,931); avirulence (avr) and disease resistance (R) genes (Jones et al. (1994) *Science* 266:789; Martin et al. (1993) *Science* 262:1432; and Mindrinos et al. (1994) *Cell* 78:1089); and the like.

Herbicide resistance traits may include genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene), glyphosate (e.g., the EPSPS gene and the GAT gene; see, for example, U.S. Publication No. 20040082770 and WO 03/092360) or other such genes known in the art. The bar gene encodes resistance to the herbicide basta, the nptII gene encodes resistance to the antibiotics kanamycin and geneticin, and the ALS-gene mutants encode resistance to the herbicide chlorsulfuron.

Sterility genes can also be encoded in an expression cassette and provide an alternative to physical detasseling. Examples of genes used in such ways include male tissue-preferred genes and genes with male sterility phenotypes such as QM, described in U.S. Pat. No. 5,583,210. Other genes include kinases and those encoding compounds toxic to either male or female gametophytic development.

The quality of grain is reflected in traits such as levels and types of oils, saturated and unsaturated, quality and quantity of essential amino acids, and levels of cellulose. In corn, modified hordothionin proteins are described in U.S. Pat. Nos. 5,703,049, 5,885,801, 5,885,802, and 5,990,389.

Commercial traits can also be encoded on a gene or genes that could increase for example, starch for ethanol production, or provide expression of proteins. Another important commercial use of transformed plants is the production of polymers and bioplastics such as described in U.S. Pat. No. 5,602,321. Genes such as β-Ketothiolase, PHBase (polyhydroxyburyrate synthase), and acetoacetyl-CoA reductase (see Schubert et al. (1988) *J. Bacteriol.* 170:5837-5847) facilitate expression of polyhyroxyalkanoates (PHAs).

Exogenous products include plant enzymes and products as well as those from other sources including prokaryotes and other eukaryotes. Such products include enzymes, cofactors, hormones, and the like. The level of proteins, particularly modified proteins having improved amino acid distribution to improve the nutrient value of the plant, can be increased. This is achieved by the expression of such proteins having enhanced amino acid content.

In an aspect, further agronomic traits of interest that can be introduced into explants with increased efficiency and speed are such traits as increased yield or other trait that provides increased plant value, including, for example, improved seed quality. Of particular interest are traits that provide improved or enhanced water use efficiency or drought tolerance, osmotic stress tolerance, high salinity stress tolerance, heat stress tolerance, enhanced cold tolerance, including cold germination tolerance, increased yield, enhanced nitrogen use efficiency, early plant growth and development, late plant growth and development, enhanced seed protein, and enhanced seed oil production.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include enhanced plant morphology, plant physiology or improved components of the mature seed harvested from the transgenic plant.

"Increased yield" of a transgenic plant of the present disclosure may be evidenced and measured in a number of ways, including test weight, seed number per plant, seed weight, seed number per unit area (i.e. seeds, or weight of seeds, per acre), bushels per acre, tons per acre, kilo per hectare. For example, maize yield may be measured as production of shelled corn kernels per unit of production area, e.g. in bushels per acre or metric tons per hectare, often reported on a moisture adjusted basis, e.g., at 15.5% moisture. Increased yield may result from improved utilization of key biochemical compounds, such as nitrogen, phosphorous and carbohydrate, or from improved tolerance to environmental stresses, such as cold, heat, drought, salt, and attack by pests or pathogens. Trait-enhancing recombinant DNA may also be used to provide transgenic plants having improved growth and development, and ultimately increased yield, as the result of modified expression of plant growth regulators or modification of cell cycle or photosynthesis pathways.

Many agronomic traits can affect "yield", including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Other traits that can affect yield include, efficiency of germination (including germination in stressed conditions), growth rate (including growth rate in stressed conditions), ear number, seed number per ear, seed size, composition of seed (starch, oil, protein) and characteristics of seed fill. Also of interest is the generation of transgenic plants that demonstrate desirable phenotypic properties that may or may not confer an increase in overall plant yield. Such properties include enhanced plant morphology, plant physiology or improved components of the mature seed harvested from the transgenic plant.

VI. Methods to Suppress Genes

In an aspect, the disclosed methods and compositions can be used to introduce into plants with increased efficiency and speed polynucleotides useful for gene suppression of a target gene in a plant. Reduction of the activity of specific genes (also known as gene silencing, or gene suppression) is desirable for several aspects of genetic engineering in plants. Many techniques for gene silencing are well known to one of skill in the art, including but not limited to antisense technology (see, e.g., Sheehy et al. (1988) Proc. Natl. Acad. Sci. USA 85:8805-8809; and U.S. Pat. Nos. 5,107,065; 5,453,566; and 5,759,829); cosuppression (e.g., Taylor (1997) Plant Cell 9:1245; Jorgensen (1990) Trends Biotech. 8(12):340-344; Flavell (1994) Proc. Natl. Acad. Sci. USA 91:3490-3496; Finnegan et al. (1994) Bio/Technology 12: 883-888; and Neuhuber et al. (1994) Mol. Gen. Genet. 244:230-241); RNA interference (Napoli et al. (1990) Plant Cell 2:279-289; U.S. Pat. No. 5,034,323; Sharp (1999) Genes Dev. 13:139-141; Zamore et al. (2000) Cell 101:25-33; Javier (2003) Nature 425:257-263; and, Montgomery et al. (1998) Proc. Natl. Acad. Sci. USA 95:15502-15507), virus-induced gene silencing (Burton, et al. (2000) Plant Cell 12:691-705; and Baulcombe (1999) Curr. Op. Plant Bio. 2:109-113); target-RNA-specific ribozymes (Haseloff et al. (1988) Nature 334: 585-591); hairpin structures (Smith et al. (2000) Nature 407:319-320; WO 99/53050; WO 02/00904; and WO 98/53083); ribozymes (Steinecke et al. (1992) EMBO J. 11:1525; U.S. Pat. No. 4,987,071; and, Perriman et al. (1993) Antisense Res. Dev. 3:253); oligonucleotide mediated targeted modification (e.g., WO 03/076574 and WO 99/25853); Zn-finger targeted molecules (e.g., WO 01/52620; WO 03/048345; and WO 00/42219); artificial micro RNAs (U.S. Pat. No. 8,106,180; Schwab et al. (2006) Plant Cell 18:1121-1133); and other methods or combinations of the above methods known to those of skill in the art.

VII. Methods to Introduce Genome Editing Technologies into Plants

In an aspect, the disclosed methods and compositions can be used to introduce into plants with increased efficiency and speed polynucleotides useful to target a specific site for modification in the genome of a plant. Site specific modifications that can be introduced with the disclosed methods and compositions include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. For example, the disclosed methods and compositions can be used to introduce a CRISPR-Cas system into plants, for the purpose of genome modification of a target sequence in the genome of a plant or plant cell, for selecting plants, for deleting a base or a sequence, for gene editing, and for inserting a polynucleotide of interest into the genome of a plant. Thus, the disclosed methods and compositions can be used together with a CRISPR-Cas system to provide for an effective system for modifying or altering target sites and nucleotides of interest within the genome of a plant, plant cell or seed.

In an aspect, the present disclosure comprises methods and compositions for producing a transgenic plant, wherein the method comprises introducing a polynucleotide of interest into a target site in the genome of a plant cell, the method comprising (a) transforming one or more cells of an explant with an expression construct comprising: (i) a nucleotide sequence encoding a WUS/WOX homeobox polypeptide; (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure, in the absence of cytokinin, wherein no callus is formed; and wherein transformation further comprises a first expression construct capable of expressing a guide nucleotide and a second recombinant DNA construct capable of expressing a Cas endonuclease, wherein the guide nucleotide and Cas endonuclease are capable of forming a complex that enables the Cas endonuclease to introduce a double strand break at the target site. Alternatively, the expression construct comprising the nucleotide sequence encoding a WUS/WOX homeobox polypeptide and/or nucleotide sequence encoding a polypeptide comprising two AP2-DNA binding domains can also comprise a nucleotide sequence capable of expressing the guide nucleotide and a nucleotide sequence capable of expressing the Cas endonuclease.

In an aspect, the Cas endonuclease gene is a plant optimized Cas9 endonuclease, wherein the plant optimized Cas9 endonuclease is capable of binding to and creating a double strand break in a genomic target sequence the plant genome.

The Cas endonuclease is guided by the guide nucleotide to recognize and optionally introduce a double strand break at a specific target site into the genome of a cell. The CRISPR-Cas system provides for an effective system for modifying target sites within the genome of a plant, plant cell or seed. Further provided are methods and compositions employing a guide polynucleotide/Cas endonuclease system to provide an effective system for modifying target sites within the genome of a cell and for editing a nucleotide sequence in the genome of a cell. Once a genomic target site is identified, a variety of methods can be employed to further modify the target sites such that they contain a variety of polynucleotides of interest. The disclosed compositions and methods can be used to introduce a CRISPR-Cas system for editing a nucleotide sequence in the genome of a cell. The nucleotide sequence to be edited (the nucleotide sequence of interest) can be located within or outside a target site that is recognized by a Cas endonuclease.

CRISPR loci (Clustered Regularly Interspaced Short Palindromic Repeats) (also known as SPIDRs-SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

CRISPR loci were first recognized in *E. coli* (Ishino et al. (1987) J. Bacterial. 169:5429-5433; Nakata et al. (1989) J. Bacterial. 171:3553-3556). Similar interspersed short sequence repeats have been identified in *Haloferax mediterranei, Streptococcus pyogenes, Anabaena*, and *Mycobacterium tuberculosis* (Groenen et al. (1993) Mol. Microbiol. 10:1057-1065; Hoe et al. (1999) Emerg. Infect. Dis. 5:254-263; Masepohl et al. (1996) Biochim. Biophys. Acta 1307: 26-30; Mojica et al. (1995) Mol. Microbiol. 17:85-93). The CRISPR loci differ from other SSRs by the structure of the repeats, which have been termed short regularly spaced repeats (SRSRs) (Janssen et al. (2002) OMICS J. Integ. Biol. 6:23-33; Mojica et al. (2000) Mol. Microbiol. 36:244-246). The repeats are short elements that occur in clusters, that are always regularly spaced by variable sequences of constant length (Mojica et al. (2000) Mol. Microbiol. 36:244-246).

Cas gene includes a gene that is generally coupled, associated or close to or in the vicinity of flanking CRISPR loci. The terms "Cas gene" and "CRISPR-associated (Cas) gene" are used interchangeably herein. A comprehensive review of the Cas protein family is presented in Haft et al. (2005) Computational Biology, PLoS Comput Biol 1 (6): e60. doi:10.1371/journal.pcbi.0010060.

In addition to the four initially described gene families, an additional 41 CRISPR-associated (Cas) gene families have been described in WO/2015/026883, which is incorporated herein by reference. This reference shows that CRISPR systems belong to different classes, with different repeat patterns, sets of genes, and species ranges. The number of Cas genes at a given CRISPR locus can vary between species. Cas endonuclease relates to a Cas protein encoded by a Cas gene, wherein the Cas protein is capable of introducing a double strand break into a DNA target sequence. The Cas endonuclease is guided by the guide polynucleotide to recognize and optionally introduce a double strand break at a specific target site into the genome of a cell. As used herein, the term "guide polynucleotide/Cas endonuclease system" includes a complex of a Cas endonuclease and a guide polynucleotide that is capable of introducing a double strand break into a DNA target sequence. The Cas endonuclease unwinds the DNA duplex in close proximity of the genomic target site and cleaves both DNA strands upon recognition of a target sequence by a guide nucleotide, but only if the correct protospacer-adjacent motif (PAM) is approximately oriented at the 3' end of the target sequence (see FIG. 2A and FIG. 2B of WO/2015/026883, published Feb. 26, 2015).

In an aspect, the Cas endonuclease gene is a Cas9 endonuclease, such as, but not limited to, Cas9 genes listed in SEQ ID NOs: 462, 474, 489, 494, 499, 505, and 518 of WO2007/025097, published Mar. 1, 2007, and incorporated herein by reference. In another aspect, the Cas endonuclease gene is plant, maize or soybean optimized Cas9 endonuclease, such as, but not limited to those shown in FIG. 1A of WO/2015/026883. In another aspect, the Cas endonuclease gene is operably linked to a SV40 nuclear targeting signal upstream of the Cas codon region and a bipartite VirD2 nuclear localization signal (Tinland et al. (1992) Proc. Natl. Acad. Sci. USA 89:7442-6) downstream of the Cas codon region.

In an aspect, the Cas endonuclease gene is a Cas9 endonuclease gene of SEQ ID NO:1, 124, 212, 213, 214, 215, 216, 193 or nucleotides 2037-6329 of SEQ ID NO:5, or any functional fragment or variant thereof, of WO/2015/026883.

The terms "functional fragment," "fragment that is functionally equivalent," and "functionally equivalent fragment" are used interchangeably herein. These terms refer to a portion or subsequence of the Cas endonuclease sequence of the present disclosure in which the ability to create a double-strand break is retained.

The terms "functional variant," "variant that is functionally equivalent" and "functionally equivalent variant" are used interchangeably herein. These terms refer to a variant of the Cas endonuclease of the present disclosure in which the ability to create a double-strand break is retained. Fragments and variants can be obtained via methods such as site-directed mutagenesis and synthetic construction.

In an aspect, the Cas endonuclease gene is a plant codon optimized *Streptococcus pyogenes* Cas9 gene that can recognize any genomic sequence of the form N(12-30)NGG can in principle be targeted.

Endonucleases are enzymes that cleave the phosphodiester bond within a polynucleotide chain, and include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Endonucleases also include meganucleases, also known as homing endonucleases (HEases), which like restriction endonucleases, bind and cut at a specific recognition site, however the recognition sites for meganucleases are typically longer, about 18 bp or more (Patent application PCT/US 12/30061 filed on Mar. 22, 2012). Meganucleases have been classified into four families based on conserved sequence motifs, the families are the LAGLIDADG, GIY-YIG, H-N-H, and His-Cys box families. These motifs participate in the coordination of metal ions and hydrolysis of phosphodiester bonds. Meganucleases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI- for enzymes encoded by free-standing ORFs, introns, and inteins, respectively. One step in the recombination process involves polynucleotide cleavage at or near the recognition site. This cleaving activity can be used to produce a double-strand break. For reviews of site-specific recombinases and their recognition sites, see, Sauer (1994) Curr Op Biotechnol 5:521-7; and Sadowski (1993) FASEB 7:760-7. In some examples the recombinase is from the Integrase or Resolvase families. TAL effector nucleases are a new class of sequence-specific nucleases that can be used to make double-strand breaks at specific target sequences in the genome of a plant or other organism. (Miller, et al. (2011) Nature Biotechnology 29:143-148). Zinc finger nucleases (ZFNs) are engineered double-strand break inducing agents comprised of a zinc finger DNA binding domain and a double-strand-break-inducing agent domain. Recognition site specificity is conferred by the zinc finger domain, which typically comprising two, three, or four zinc fingers, for example having a C2H2 structure, however other zinc finger structures are known and have been engineered. Zinc finger domains are amenable for designing polypeptides which specifically bind a selected polynucleotide recognition sequence. ZFNs include an engineered DNA-binding zinc finger domain linked to a nonspecific endonuclease domain, for example nuclease domain from a Type Ms endonuclease such as Fok1. Additional functionalities can be fused to the zinc-finger binding domain, including transcriptional activator domains, transcription repressor domains, and methylases. In some examples, dimerization of nuclease domain is required for cleavage activity. Each zinc finger recognizes three consecutive base pairs in the target DNA. For example, a 3 finger domain recognized a sequence of 9 contiguous nucleotides, with a dimerization requirement of the nuclease, two sets of zinc finger triplets are used to bind an 18 nucleotide recognition sequence.

Bacteria and archaea have evolved adaptive immune defenses termed clustered regularly interspaced short palindromic repeats (CRISPR)/CRISPR-associated (Cas) systems that use short RNA to direct degradation of foreign nucleic acids ((WO2007/025097 published Mar. 1, 2007). The type II CRISPR/Cas system from bacteria employs a crRNA and tracrRNA to guide the Cas endonuclease to its DNA target. The crRNA (CRISPR RNA) contains the region complementary to one strand of the double strand DNA target and base pairs with the tracrRNA (trans-activating CRISPR RNA) forming a RNA duplex that directs the Cas endonuclease to cleave the DNA target.

As used herein, the term "guide nucleotide" relates to a synthetic fusion of two RNA molecules, a crRNA (CRISPR RNA) comprising a variable targeting domain, and a tracrRNA. In an aspect, the guide nucleotide comprises a variable targeting domain of 12 to 30 nucleotide sequences and a RNA fragment that can interact with a Cas endonuclease.

As used herein, the term "guide polynucleotide" relates to a polynucleotide sequence that can form a complex with a Cas endonuclease and enables the Cas endonuclease to recognize and optionally cleave a DNA target site. The guide polynucleotide can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide nucleotide".

The guide polynucleotide can be a double molecule (also referred to as duplex guide polynucleotide) comprising a first nucleotide sequence domain (referred to as Variable Targeting domain or VT domain) that is complementary to a nucleotide sequence in a target DNA and a second nucleotide sequence domain (referred to as Cas endonuclease recognition domain or CER domain) that interacts with a Cas endonuclease polypeptide. The CER domain of the double molecule guide polynucleotide comprises two separate molecules that are hybridized along a region of complementarity. The two separate molecules can be RNA, DNA, and/or RNA-DNA-combination sequences. In an aspect, the first molecule of the duplex guide polynucleotide comprising a VT domain linked to a CER domain is referred to as "crDNA" (when composed of a contiguous stretch of DNA nucleotides) or "crRNA" (when composed of a contiguous stretch of RNA nucleotides), or "crDNA-RNA" (when composed of a combination of DNA and RNA nucleotides). The crNucleotide can comprise a fragment of the cRNA naturally occurring in Bacteria and Archaea. In an aspect, the size of the fragment of the cRNA naturally occurring in Bacteria and Archaea that is present in a crNucleotide disclosed herein can range from, but is not limited to, 2, 3, 4, 5, 6, 7, 8, 9, 10, 11, 12, 13, 14, 15, 16, 17, 18, 19, 20 or more nucleotides.

In an aspect, the second molecule of the duplex guide polynucleotide comprising a CER domain is referred to as "tracrRNA" (when composed of a contiguous stretch of RNA nucleotides) or "tracrDNA" (when composed of a contiguous stretch of DNA nucleotides) or "tracrDNA-RNA" (when composed of a combination of DNA and RNA nucleotides In an aspect, the RNA that guides the RNA Cas9 endonuclease complex, is a duplexed RNA comprising a duplex crRNA-tracrRNA.

The guide polynucleotide can also be a single molecule comprising a first nucleotide sequence domain (referred to as Variable Targeting domain or VT domain) that is complementary to a nucleotide sequence in a target DNA and a second nucleotide domain (referred to as Cas endonuclease recognition domain or CER domain) that interacts with a Cas endonuclease polypeptide. By "domain" it is meant a contiguous stretch of nucleotides that can be RNA, DNA, and/or RNA-DNA-combination sequence. The VT domain and/or the CER domain of a single guide polynucleotide can comprise a RNA sequence, a DNA sequence, or a RNA-DNA-combination sequence. In an aspect the single guide polynucleotide comprises a crNucleotide (comprising a VT domain linked to a CER domain) linked to a tracrNucleotide (comprising a CER domain), wherein the linkage is a nucleotide sequence comprising a RNA sequence, a DNA sequence, or a RNA-DNA combination sequence. The single guide polynucleotide being comprised of sequences from the crNucleotide and tracrNucleotide may be referred to as "single guide nucleotide" (when composed of a contiguous stretch of RNA nucleotides) or "single guide DNA" (when composed of a contiguous stretch of DNA nucleotides) or "single guide nucleotide-DNA" (when composed of a combination of RNA and DNA nucleotides). In an aspect of the disclosure, the single guide nucleotide comprises a cRNA or cRNA fragment and a tracrRNA or tracrRNA fragment of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. One aspect of using a single guide polynucleotide versus a duplex guide polynucleotide is that only one expression cassette needs to be made to express the single guide polynucleotide.

The term "variable targeting domain" or "VT domain" is used interchangeably herein and includes a nucleotide sequence that is complementary to one strand (nucleotide sequence) of a double strand DNA target site. The % complementation between the first nucleotide sequence domain (VT domain) and the target sequence can be at least 50%, 51%, 52%, 53%, 54%, 55%, 56%, 57%, 58%, 59%, 60%, 61%, 62%, 63%, 63%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100%. The variable target domain can be at least 12, 13, 14, 15, 16, 17, 18, 19, 20, 21, 22, 23, 24, 25, 26, 27, 28, 29 or 30 nucleotides in length. In an aspect, the variable targeting domain comprises a contiguous stretch of 12 to 30 nucleotides. The variable targeting domain can be composed of a DNA sequence, a RNA sequence, a modified DNA sequence, a modified RNA sequence, or any combination thereof.

The term "Cas endonuclease recognition domain" or "CER domain" of a guide polynucleotide is used interchangeably herein and includes a nucleotide sequence (such as a second nucleotide sequence domain of a guide polynucleotide), that interacts with a Cas endonuclease polypeptide. The CER domain can be composed of a DNA sequence, a RNA sequence, a modified DNA sequence, a modified RNA sequence (see for example modifications described herein), or any combination thereof.

The nucleotide sequence linking the crNucleotide and the tracrNucleotide of a single guide polynucleotide can comprise a RNA sequence, a DNA sequence, or a RNA-DNA combination sequence. In an aspect, the nucleotide sequence linking the crNucleotide and the tracrNucleotide of a single guide polynucleotide can be at least 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 78, 79, 80, 81, 82, 83, 84, 85, 86, 87, 88, 89, 90, 91, 92, 93, 94, 95, 96, 97, 98, 99 or 100 nucleotides in length. In another aspect, the nucleotide sequence linking the crNucleotide and the tracrNucleotide of a single guide polynucleotide can comprise a tetraloop sequence, such as, but not limiting to a GAAA tetraloop sequence.

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

In an aspect, the guide nucleotide and Cas endonuclease are capable of forming a complex that enables the Cas endonuclease to introduce a double strand break at a DNA target site.

In an aspect of the disclosure the variable target domain is 12, 13, 14, 15, 16, 17, 18, 19, 20, 21, 22, 23, 24, 25, 26, 27, 28, 29 or 30 nucleotides in length.

In an aspect of the disclosure, the guide nucleotide comprises a cRNA (or cRNA fragment) and a tracrRNA (or tracrRNA fragment) of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. In an aspect the guide nucleotide can be introduced into a plant or plant cell directly using any method known in the art such as, but not limited to, particle bombardment or topical applications.

In an aspect, the guide nucleotide can be introduced indirectly by introducing a recombinant DNA molecule comprising the corresponding guide DNA sequence operably linked to a plant specific promoter that is capable of transcribing the guide nucleotide in the plant cell. The term "corresponding guide DNA" includes a DNA molecule that is identical to the RNA molecule but has a "T" substituted for each "U" of the RNA molecule.

In an aspect, the guide nucleotide is introduced via particle bombardment or using the disclosed methods and compositions for *Agrobacterium* transformation of a recombinant DNA construct comprising the corresponding guide DNA operably linked to a plant U6 polymerase III promoter.

In an aspect, the RNA that guides the RNA Cas9 endonuclease complex, is a duplexed RNA comprising a duplex crRNA-tracrRNA. One advantage of using a guide nucleotide versus a duplexed crRNA-tracrRNA is that only one expression cassette needs to be made to express the fused guide nucleotide.

The terms "target site," "target sequence," "target DNA," "target locus," "genomic target site," "genomic target sequence," and "genomic target locus" are used interchangeably herein and refer to a polynucleotide sequence in the genome (including choroplastic and mitochondrial DNA) of a plant cell at which a double-strand break is induced in the plant cell genome by a Cas endonuclease. The target site can be an endogenous site in the plant genome, or alternatively, the target site can be heterologous to the plant and thereby not be naturally occurring in the genome, or the target site can be found in a heterologous genomic location compared to where it occurs in nature.

As used herein, terms "endogenous target sequence" and "native target sequence" are used interchangeably herein to refer to a target sequence that is endogenous or native to the genome of a plant and is at the endogenous or native position of that target sequence in the genome of the plant. In an aspect, the target site can be similar to a DNA recognition site or target site that that is specifically recognized and/or bound by a double-strand break inducing agent such as a LIG3-4 endonuclease (US patent publication 2009-0133152 A1 (published May 21, 2009) or a MS26++ meganuclease (U.S. patent application Ser. No. 13/526,912 filed Jun. 19, 2012).

An "artificial target site" or "artificial target sequence" are used interchangeably herein and refer to a target sequence that has been introduced into the genome of a plant. Such an artificial target sequence can be identical in sequence to an endogenous or native target sequence in the genome of a plant but be located in a different position (i.e., a non-endogenous or non-native position) in the genome of a plant.

An "altered target site," "altered target sequence" "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

VIII. Methods to Introduce Nucleotides for Site-Specific Integration

In an aspect, the disclosed methods and compositions can be used to introduce into plants with increased efficiency and speed polynucleotides useful for the targeted integration of nucleotide sequences into a plant. For example, the disclosed methods and compositions can be used to introduce transfer cassettes comprising nucleotide sequences of interest flanked by non-identical recombination sites are used to transform a plant comprising a target site. In an aspect, the target site contains at least a set of non-identical recombination sites corresponding to those on the transfer cassette. The exchange of the nucleotide sequences flanked by the recombination sites is affected by a recombinase. Thus, the disclosed methods and compositions can be used for the introduction of transfer cassettes for targeted integration of nucleotide sequences, wherein the transfer cassettes which are flanked by non-identical recombination sites recognized by a recombinase that recognizes and implements recombination at the nonidentical recombination sites. Accordingly, the disclosed methods and composition can be used to improve efficiency and speed of development of plants, derived from regenerable plant structures, containing non-identical recombination sites.

In an aspect, the present disclosure comprises methods and compositions for producing a transgenic plant, wherein the method comprises introducing a polynucleotide of interest into a target site in the genome of a plant cell, the method comprising (a) transforming one or more cells of an explant with an expression construct comprising: (i) a nucleotide sequence encoding a WUS/WOX homeobox polypeptide; (ii) a nucleotide sequence encoding a polypeptide comprising two AP2-DNA binding domains; or (iii) a combination of (i) and (ii); and (b) allowing expression of the polypeptide of (a) in each transformed cell to form a regenerable plant structure in the absence of cytokinin, wherein no callus is formed; wherein transformation further comprises transforming a cell of an explant with a transfer cassette comprising a nucleotide sequence of interest flanked by non-identical recombination sites; and wherein the explant is derived from a plant with a genome comprising a target site flanked by non identical recombination sites which correspond to the flanking sites of the transfer cassette. The method can further comprise providing a recombinase that recognizes and implements recombination at the nonidentical recombination sites, the recombinase being provided to the one or more cells of the explant, a regenerable plant structure, a plantlet derived from the regenerable plant structure, or a plant derived from a plantlet derived a regenerable plant structure.

Thus, the disclosed methods and compositions can further comprise compositions and methods for the directional, targeted integration of exogenous nucleotides into a transformed plant are provided. In an aspect, the disclosed methods use novel recombination sites in a gene targeting system which facilitates directional targeting of desired genes and nucleotide sequences into corresponding recombination sites previously introduced into the target plant genome.

In an aspect, a nucleotide sequence flanked by two non-identical recombination sites is introduced into one or more cells of an explant derived from the target organism's genome establishing a target site for insertion of nucleotide sequences of interest. Once a stable plant or cultured tissue is established a second construct, or nucleotide sequence of interest, flanked by corresponding recombination sites as those flanking the target site, is introduced into the stably transformed plant or tissues in the presence of a recombinase protein. This process results in exchange of the nucleotide sequences between the non-identical recombination sites of the target site and the transfer cassette.

It is recognized that the transformed plant prepared in this manner may comprise multiple target sites; i. e., sets of non-identical recombination sites. In this manner, multiple manipulations of the target site in the transformed plant are available. By target site in the transformed plant is intended a DNA sequence that has been inserted into the transformed plant's genome and comprises non-identical recombination sites.

Examples of recombination sites for use in the disclosed method are known in the art and include FRT sites (See, for example, Schlake and Bode (1994) Biochemistry 33: 12746-12751; Huang et al. (1991) Nucleic Acids Research 19: 443-448; Paul D. Sadowski (1995) In Progress in Nucleic Acid Research and Molecular Biology vol. 51, pp. 53-91; Michael M. Cox (1989) In Mobile DNA, Berg and Howe (eds) American Society of Microbiology, Washington D.C., pp. 116-670; Dixon et al. (1995) 18: 449-458; Umlauf and Cox (1988) The EMBO Journal 7: 1845-1852; Buchholz et al. (1996) Nucleic Acids Research 24: 3118-3119; Kilby et al. (1993) Trends Genet. 9: 413-421: Rossant and Geagy (1995) Nat. Med. 1: 592-594; Albert et al. (1995) The Plant J. 7: 649-659: Bayley et al. (1992) Plant Mol. Biol. 18: 353-361; Odell et al. (1990) Mol. Gen. Genet. 223: 369-378; and Dale and Ow (1991) Proc. Natl. Acad. Sci. USA 88: 10558-105620; all of which are herein incorporated by reference.; Lox (Albert et al. (1995) Plant J. 7: 649-659; Qui et al. (1994) Proc. Natl. Acad. Sci. USA 91: 1706-1710; Stuurman et al. (1996) Plant Mol. Biol. 32: 901-913; Odell et al. (1990) Mol. Gen. Gevet. 223: 369-378; Dale et al. (1990) Gene 91: 79-85; and Bayley et al. (1992) Plant Mol. Biol. 18: 353-361.) The two-micron plasmid found in most naturally occurring strains of Saccharomyces cerevisiae, encodes a site-specific recombinase that promotes an inversion of the DNA between two inverted repeats. This inversion plays a central role in plasmid copy-number amplification.

The protein, designated FLP protein, catalyzes site-specific recombination events. The minimal recombination site (FRT) has been defined and contains two inverted 13-base pair (bp) repeats surrounding an asymmetric 8-bp spacer. The FLP protein cleaves the site at the junctions of the repeats and the spacer and is covalently linked to the DNA via a 3'phosphate. Site specific recombinases like FLP cleave and relegate DNA at specific target sequences, resulting in a precisely defined recombination between two identical sites. To function, the system needs the recombination sites and the recombinase. No auxiliary factors are needed. Thus, the entire system can be inserted into and function in plant cells. The yeast FLP\FRT site specific recombination system has been shown to function in plants. To date, the system has been utilized for excision of unwanted DNA. See, Lyznik et at. (1993) Nucleic Acid Res. 21: 969-975. In contrast, the present disclosure utilizes non-identical FRTs for the exchange, targeting, arrangement, insertion and control of expression of nucleotide sequences in the plant genome.

In an aspect, a transformed organism of interest, such as an explant from a plant, containing a target site integrated into its genome is needed. The target site is characterized by being flanked by non-identical recombination sites. A targeting cassette is additionally required containing a nucleotide sequence flanked by corresponding non-identical recombination sites as those sites contained in the target site of the transformed organism. A recombinase which recognizes the non-identical recombination sites and catalyzes site-specific recombination is required.

It is recognized that the recombinase can be provided by any means known in the art. That is, it can be provided in the organism or plant cell by transforming the organism with an expression cassette capable of expressing the recombinase in the organism, by transient expression, or by providing messenger RNA (mRNA) for the recombinase or the recombinase protein.

By "non-identical recombination sites" it is intended that the flanking recombination sites are not identical in sequence and will not recombine or recombination between the sites will be minimal. That is, one flanking recombination site may be a FRT site where the second recombination site may be a mutated FRT site. The non-identical recombination sites used in the methods of the disclosure prevent or greatly suppress recombination between the two flanking recombination sites and excision of the nucleotide sequence contained therein. Accordingly, it is recognized that any suitable non-identical recombination sites may be utilized in the disclosure, including FRT and mutant FRT sites, FRT and lox sites, lox and mutant lox sites, as well as other recombination sites known in the art.

By suitable non-identical recombination site implies that in the presence of active recombinase, excision of sequences between two non-identical recombination sites occurs, if at all, with an efficiency considerably lower than the recombinationally-mediated exchange targeting arrangement of nucleotide sequences into the plant genome. Thus, suitable non-identical sites for use in the disclosure include those sites where the efficiency of recombination between the sites is low; for example, where the efficiency is less than about 30 to about 50%, preferably less than about 10 to about 30%, more preferably less than about 5 to about 10%.

As noted above, the recombination sites in the targeting cassette correspond to those in the target site of the transformed plant. That is, if the target site of the transformed plant contains flanking non-identical recombination sites of FRT and a mutant FRT, the targeting cassette will contain the same FRT and mutant FRT non-identical recombination sites.

It is furthermore recognized that the recombinase, which is used in the disclosed methods, will depend upon the recombination sites in the target site of the transformed plant and the targeting cassette. That is, if FRT sites are utilized, the FLP recombinase will be needed. In the same manner, where lox sites are utilized, the Cre recombinase is required. If the non-identical recombination sites comprise both a FRT and a lox site, both the FLP and Cre recombinase will be required in the plant cell.

The FLP recombinase is a protein which catalyzes a site-specific reaction that is involved in amplifying the copy number of the two micron plasmid of *S. cerevisiae* during DNA replication. FLP protein has been cloned and expressed. See, for example, Cox (1993) Proc. Natl. Acad. Sci. U.S.A. 80: 4223-4227. The FLP recombinase for use in the disclosure may be that derived from the genus *Saccharomyces*. It may be preferable to synthesize the recombinase using plant preferred codons for optimum expression in a plant of interest. See, for example, U.S. application Ser. No. 08/972,258 filed Nov. 18, 1997, entitled "Novel Nucleic Acid Sequence Encoding FLP Recombinase," herein incorporated by reference.

The bacteriophage recombinase Cre catalyzes site-specific recombination between two lox sites. The Cre recombinase is known in the art. See, for example, Guo et al. (1997) Nature 389: 40-46; Abremski et al. (1984) J. Biol. Chem. 259: 1509-1514; Chen et al. (1996) Somat. Cell Mol. Genet. 22: 477-488; and Shaikh et al. (1977) J. Biol. Chem. 272: 5695-5702. All of which are herein incorporated by reference. Such Cre sequence may also be synthesized using plant preferred codons.

Where appropriate, the nucleotide sequences to be inserted in the plant genome may be optimized for increased expression in the transformed plant. Where mammalian, yeast, or bacterial genes are used in the disclosure, they can be synthesized using plant preferred codons for improved expression. It is recognized that for expression in monocots, dicot genes can also be synthesized using monocot preferred codons. Methods are available in the art for synthesizing plant preferred genes. See, for example, U.S. Pat. Nos. 5,380,831, 5,436,391, and Murray et al. (1989) Nucleic Acids Res. 17: 477-498, herein incorporated by reference. The plant preferred codons may be determined from the codons utilized more frequently in the proteins expressed in the plant of interest. It is recognized that monocot or dicot preferred sequences may be constructed as well as plant preferred sequences for particular plant species. See, for example, EPA 0359472; EPA 0385962; WO 91/16432; Perlak et al. (1991) Proc. Natl. Acad. Sci. USA, 88: 3324-3328; and Murray et al. (1989) Nucleic Acids Research, 17: 477-498. U.S. Pat. Nos. 5,380,831; 5,436,391; and the like, herein incorporated by reference. It is further recognized that all or any part of the gene sequence may be optimized or synthetic. That is, fully optimized or partially optimized sequences may also be used.

Additional sequence modifications are known to enhance gene expression in a cellular host and can be used in the disclosure. These include elimination of sequences encoding spurious polyadenylation signals, exon-intron splice site signals, transposon-like repeats, and other such well-characterized sequences, which may be deleterious to gene expression. The G-C content of the sequence may be adjusted to levels average for a given cellular host, as calculated by reference to known genes expressed in the host cell. When possible, the sequence is modified to avoid predicted hairpin secondary RNA structures.

The present disclosure also encompasses novel FLP recombination target sites (FRT). The FRT has been identified as a minimal sequence comprising two 13 base pair repeats, separated by an 8 base spacer, as follows: 5'-GAAGTTCCTATTC [TCTAGAAA] GTATAG-GAACTTC3' wherein the nucleotides within the brackets indicate the spacer region. The nucleotides in the spacer region can be replaced with a combination of nucleotides, so long as the two 13-base repeats are separated by eight nucleotides. It appears that the actual nucleotide sequence of the spacer is not critical; however for the practice of the disclosure, some substitutions of nucleotides in the space region may work better than others. The eight base pair spacer is involved in DNA-DNA pairing during strand exchange. The asymmetry of the region determines the direction of site alignment in the recombination event, which will subsequently lead to either inversion or excision. As indicated above, most of the spacer can be mutated without a loss of function. See, for example, Schlake and Bode (1994) Biochemistry 33: 12746-12751, herein incorporated by reference.

Novel FRT mutant sites can be used in the practice of the disclosed methods. Such mutant sites may be constructed by PCR-based mutagenesis. Although mutant FRT sites are known (see SEQ ID Nos 2, 3, 4 and 5 of WO/1999/025821, published May 27, 1999), it is recognized that other mutant FRT sites may be used in the practice of the disclosure. The present disclosure is not the use of a particular FRT or recombination site, but rather that non-identical recombination sites or FRT sites can be utilized for targeted insertion and expression of nucleotide sequences in a plant genome. Thus, other mutant FRT sites can be constructed and utilized based upon the present disclosure.

As discussed above, bringing genomic DNA containing a target site with non-identical recombination sites together with a vector containing a transfer cassette with corresponding non-identical recombination sites, in the presence of the recombinase, results in recombination. The nucleotide sequence of the transfer cassette located between the flanking recombination sites is exchanged with the nucleotide sequence of the target site located between the flanking recombination sites. In this manner, nucleotide sequences of interest may be precisely incorporated into the genome of the host.

It is recognized that many variations of the disclosure can be practiced. For example, target sites can be constructed having multiple non-identical recombination sites. Thus, multiple genes or nucleotide sequences can be stacked or ordered at precise locations in the plant genome. Likewise, once a target site has been established within the genome, additional recombination sites may be introduced by incorporating such sites within the nucleotide sequence of the transfer cassette and the transfer of the sites to the target sequence. Thus, once a target site has been established, it is possible to subsequently add sites, or alter sites through recombination.

Another variation includes providing a promoter or transcription initiation region operably linked with the target site in an organism. Preferably, the promoter will be 5' to the first recombination site. By transforming the organism with a transfer cassette comprising a coding region, expression of the coding region will occur upon integration of the transfer cassette into the target site. This aspect provides for a method to select transformed cells, particularly plant cells, by providing a selectable marker sequence as the coding sequence.

Other advantages of the present system include the ability to reduce the complexity of integration of transgenes or transferred DNA in an organism by utilizing transfer cassettes as discussed above and selecting organisms with simple integration patterns. In the same manner, preferred sites within the genome can be identified by comparing several transformation events. A preferred site within the genome includes one that does not disrupt expression of essential sequences and provides for adequate expression of the transgene sequence.

The disclosed methods also provide for means to combine multiple cassettes at one location within the genome. Recombination sites may be added or deleted at target sites within the genome.

Any means known in the art for bringing the three components of the system together may be used in the disclosure. For example, a plant can be stably transformed to harbor the target site in its genome. The recombinase may be transiently expressed or provided. Alternatively, a nucleotide sequence capable of expressing the recombinase may be stably integrated into the genome of the plant. In the presence of the corresponding target site and the recombinase, the transfer cassette, flanked by corresponding non-identical recombination sites, is inserted into the transformed plant's genome.

Alternatively, the components of the system may be brought together by sexually crossing transformed plants. In this aspect, a transformed plant, parent one, containing a target site integrated in its genome can be sexually crossed with a second plant, parent two, that has been genetically transformed with a transfer cassette containing flanking non-identical recombination sites, which correspond to those in plant one. Either plant one or plant two contains within its genome a nucleotide sequence expressing recombinase. The recombinase may be under the control of a constitutive or inducible promoter.

Inducible promoters include those described herein above, as well as, heat-inducible promoters, estradiol-responsive promoters, chemical inducible promoters, and the like. Pathogen inducible promoters include those from pathogenesis-related proteins (PR proteins), which are induced following infection by a pathogen; e. g., PR proteins, SAR proteins, beta-1,3-glucanase, chitinase, etc. See, for example, Redolfi et al. (1983) Neth. J. Plant Pathol. 89: 245-254; Uknes et al. (1992) The Plant Cell 4: 645-656; and Van Loon (1985) Plant Mol. Virol. 4: 111-116. In this manner, expression of recombinase and subsequent activity at the recombination sites can be controlled.

Constitutive promoters for use in expression of genes in plants are known in the art. Such promoters include, but are not limited to 35S promoter of cauliflower mosaic virus (Depicker et al. (1982) Mol. Appl. Genet. 1: 561-573; Odell et al. (1985) Nature 313: 810-812), ubiquitin promoter (Christensen et al. (1992) Plant Mol. Biol. 18: 675-689), promoters from genes such as ribulose bisphosphate carboxylase (De Almeida et al. (1989) Mol. Gen. Genet. 218: 78-98), actin (McElroy et al. (1990) Plant J. 2: 163-171), histone, DnaJ (Baszczynski et al. (1997) Maydica 42: 189-201), and the like.

The disclosed compositions and methods are useful in targeting the integration of transferred nucleotide sequences to a specific chromosomal site. The nucleotide sequence may encode any nucleotide sequence of interest. Particular genes of interest include those which provide a readily analyzable functional feature to the host cell and/or organism, such as marker genes, as well as other genes that alter the phenotype of the recipient cells, and the like. Thus, genes effecting plant growth, height, susceptibility to disease, insects, nutritional value, and the like may be utilized in the disclosure. The nucleotide sequence also may encode an 'antisense' sequence to turn off or modify gene expression.

It is recognized that the nucleotide sequences will be utilized in a functional expression unit or cassette. By functional expression unit or cassette is intended, the nucleotide sequence of interest with a functional promoter, and in most instances a termination region. There are various ways to achieve the functional expression unit within the practice of the disclosure. In one aspect of the disclosure, the nucleic acid of interest is transferred or inserted into the genome as a functional expression unit.

Alternatively, the nucleotide sequence may be inserted into a site within the genome which is 3' to a promoter region. In this latter instance, the insertion of the coding sequence 3' to the promoter region is such that a functional expression unit is achieved upon integration. For convenience, for expression in plants, the nucleic acid encoding target sites and the transfer cassettes, including the nucleotide sequences of interest, can be contained within expression cassettes. The expression cassette will comprise a transcriptional initiation region, or promoter, operably linked to the nucleic acid encoding the peptide of interest. Such an expression cassette is provided with a plurality of restriction sites for insertion of the gene or genes of interest to be under the transcriptional regulation of the regulatory regions.

The transcriptional initiation region, the promoter, may be native or homologous or foreign or heterologous to the host, or could be the natural sequence or a synthetic sequence. By foreign is intended that the transcriptional initiation region is not found in the wild-type host into which the transcriptional initiation region is introduced. Either a native or heterologous promoter may be used with respect to the coding sequence of interest.

The transcriptional cassette will include in the 5'-3' direction of transcription, a transcriptional and translational initiation region, a DNA sequence of interest, and a transcriptional and translational termination region functional in plants. The termination region may be native with the transcriptional initiation region, may be native with the DNA sequence of interest, or may be derived from another source. Convenient termination regions are available from the potato proteinase inhibitor (PinII) gene or sequences from Ti-plasmid of *A. tumefaciens*, such as the nopaline synthase, octopine synthase and opaline synthase termination regions. See also, Guerineau et al., (1991) Mol. Gen. Genet. 262: 141-144; Proudfoot (1991) Cell 64: 671-674; Sanfacon et al. (1991) Genes Dev. 5: 141-149; Mogen et al. (1990) Plant Cell 2: 1261-1272; Munroe et al. (1990) Gene 91: 151-158; Ballas et al. 1989) Nucleic Acids Res. 17: 7891-7903; Joshi et al. (1987) Nucleic Acid Res. 15: 9627-9639.

The expression cassettes may additionally contain 5' leader sequences in the expression cassette construct. Such leader sequences can act to enhance translation. Translation leaders are known in the art and include: picornavirus leaders, for example, EMCV leader (Encephalomyocarditis 5'noncoding region) (Elroy-Stein, O., Fuerst, T. R., and Moss, B. (1989) PNAS USA, 86: 6126-6130); potyvirus leaders, for example, TEV leader (Tobacco Etch Virus) (Allison et al. (1986); MDMV leader (Maize Dwarf Mosaic Virus); Virology, 154: 9-20), and human immunoglobulin heavy-chain binding protein (BiP), (Macejak, D. G., and P. Sarnow (1991) Nature, 353: 90-94; untranslated leader from the coat protein MARNA of alfalfa mosaic virus (AMV RNA 4), (Jobling, S. A., and Gehrke, L., (1987) Nature, 325: 622-625; tobacco mosaic virus leader (TMV), (Gallie et al. (1989) Molecular Biology of RNA, pages 237-256, Gallie et al. (1987) Nucl. Acids Res. 15: 3257-3273; maize chlorotic mottle virus leader (MCMV) (Lornmel, S. A. et al. (1991) Virology, 81: 382-385). See also, Della-Cioppa et al. (1987) Plant Physiology, 84: 965-968; and endogenous maize 5' untranslated sequences. Other methods known to enhance translation can also be utilized, for example, introns, and the like.

The expression cassettes may contain one or more than one gene or nucleic acid sequence to be transferred and expressed in the transformed plant. Thus, each nucleic acid sequence will be operably linked to 5' and 3' regulatory sequences. Alternatively, multiple expression cassettes may be provided.

EXPERIMENTAL

Example 1: Plasmids

Plasmids comprising T-DNA described in Table 1 were used in experiments described herein below. The listed plasmids in Table 1 harbor a T-DNA containing the indicated components.

TABLE 1

| Plasmid Components. | |
|---|---|
| Plasmid ID | T-DNA |
| PHP77833 | RB + NOS PRO:Top2:ZM-WUS2::IN2-1 TERM + ZM-PLTP PRO::ZM-ODP2::OS-T28 TERM + GZ-W64A TERM + UBI PRO:UBI1ZM INTRON:ESR::SB-SAG12 TERM + SB-ALS PRO:: HRA::SB-PEPC1 TERM + LTP2 PRO::ZS-YELLOW::PINII TERM-LB (SEQ ID NO: 22). |
| PHP78156 | RB + NOS PRO:Top2:WUS2::IN2-1 TERM + DR5 PRO:Top3:ODP2::OS-T28 TERM + GZ-W64A TERM + UBI PRO::ESR::SB-SAG12 TERM + SB-ALS PRO:: HRA::SB-PEPC1 TERM + LTP2 PRO::ZS-YELLOW::PINII TERM-LB (SEQ ID NO: 24). |
| PHP78157 | RB + NOS PRO:Top2:ZM-WUS2::IN2-1 TERM + ZM-PLTP PRO:Top:ZM-ODP2::OS-T28 TERM + GZ-W64A TERM + UBI PRO:UBI1ZM INTRON:ESR::SB-SAG12 TERM + SB-ALS PRO:: HRA::SB-PEPC1 TERM + LTP2 PRO::ZS-YELLOW::PINII TERM-LB (SEQ ID NO: 23). |
| PHP79023 | RB + DR5 PRO::ZM-WUS2::PINII TERM + ZM-PLTP PRO::ZM-ODP2::OS-T28 TERM + GZ-W64A TERM + UBI PRO:UBI1ZM INTRON:ESR::SB-SAG12 TERM + SB-ALS PRO:: HRA::SB-PEPC1 TERM + UBI PRO:UBI1ZM INTRON:ZS-GREEN1::PINII TERM:SB-ACTIN TERM-LB (SEQ ID NO: 25). |
| PHP79024 | RB + ZM-AXIG1 PRO:Top1:ZM-WUS2::IN2-1 TERM + ZM-PLTP PRO::ZM-ODP2::OS-T28 TERM + GZ-W64A TERM + UBI PRO:UBI1ZM INTRON:ESR::SB-SAG12 TERM + SB-ALS PRO:: HRA::SB-PEPC1 TERM + UBI PRO::ZS-GREEN1::PINII TERM:SB-ACTIN TERM-LB (SEQ ID NO: 26). |

TABLE 1-continued

Plasmid Components.

| Plasmid ID | T-DNA |
|---|---|
| PHP79066 | RB-ZM-AXIG1 PRO:Top1:ZM-WUS2::In2-1 TERM + ZM-PLTP PRO::ZM-ODP2::OS-T28 TERM + SB-ALS PRO::HRA::SB-PEPC1 TERM + LTP2 PRO::ZS-YELLOW N1::PINII TERM-LB (SEQ ID NO: 28). |
| PHP80334 | RB + LOXP-ZM-AXIG1 PRO:Top1:ZM-WUS2::IN2-1 TERM + ZM-PLTP PRO:ZM-ODP2::OS-T28 TERM:PINII TERM:CZ19B1 TERM + UBI PRO:UBI1ZM INTRON:MO-CRE EXON1:ST-LS1 INTRON2:MO-CRE EXON2::PINII + SB-UBI PRO::ZS-GREEN1::PINII TERM:SB-ACTIN TERM + CAMV35S PRO::ADH1 INTRON1::ESR::SB-SAG12 TERM-LOXP + SB-ALS PRO:: HRA::PINII TERM-LB (SEQ ID NO: 41). |
| PHP80338 | RB + LOXP-ZM-AXIG1 PRO:Top1:WUS2::IN2-1 TERM + ZM-PLTP PRO:ZM-ODP2::OS-T28 TERM:PINII TERM:CZ19B1 TERM + GLB1 PRO::MO-CRE EXON1:ST-LS1 INTRON2::MO-CRE EXON2::PINII + SB-UBI PRO::ZS-GREEN1::PINII TERM:SB-ACTIN TERM + CAMV35S PRO::ADH1 INTRON1::ESR::SB-SAG12 TERM-LOXP + SB-ALS PRO:: HRA::PINII TERM-LB (SEQ ID NO: 42) |
| PHP38332 | RB + UBI PRO:UBI1 ZM INTRON:PMI::PINII TERM + UBI PRO:UBI1 ZM INTRON:MO-PAT::ZS-YELLOW-N1::PINII TERM -LB (SEQ ID NO: 43). |
| PHP80921 | RB + SI-UBI3 PRO::SI-UBI3 INTRON1::ZS-GREEN1::PINII TERM + SB-ALS PRO:HRA:SB-PEPC1 TERM + LB (SEQ IDNO: 44). |
| PHP80560 | RB + LOXP-ZM-AXIG1 PRO::ZM-WUS2::IN2-1 TERM + ZM-PLTP PRO::ZM-ODP2::OS-T28 TERM::PINII TERM::CZ19B1 TERM + ZM-IN2-2 PRO::MO-CRE EXON1:ST-LS1 INTRON2::MO-CRE EXON2::PINII + SB-UBI PRO::ZS-GREEN1::PINII TERM::SB-ACTIN TERM + LOXP + SB-ALS PRO:: HRA::PINII TERM-LB (SEQ ID NO: 44). |
| PHP82240 | RB + LOXP-ZM-AXIG1 PRO:Top1::WUS2::IN2-1 TERM + ZM-PLTP PRO:ZM-ODP2::OS-T28 TERM::PINII TERM:CZ19B1 TERM + ZM-GOS2 PRO::SB-UBI INTRON1::EC-LEXA-ZM-CI::SB-ACTIN TERM + 6X EC-RECA::CAMV 35S-MIN PRO::DS-RED::OS-UBI TERM + SB-ALS PRO:: HRA::PINII TERM-LB (SEQ ID NO: 85). |
| PHP81814 | RB + SB-ALS PRO::HRA EXON1:: LOXP + ZM-AXIG1 PRO::ZM-WUS2::IN2-1 TERM + ZM-PLTP PRO::ZM-ODP2::OS-T28 TERM::PINII TERM::CZ19B1 TERM + ZM-GLB1 PRO::MO-CRE EXON1:ST-LS1 INTRON2::MO-CRE EXON2::PINII + SB-UBI PRO::ZS-GREEN1::OS-UBI TERM + LOXP-HRA EXON2::SB-PEPC1 TERM + -LB (SEQ ID NO: 80). |
| PHP80558 | RB + LOXP-ZM-AXIG1 PRO:Top1::WUS2::IN2-1 TERM + ZM-PLTP PRO:ZM-ODP2::OS-T28 TERM:PINII TERM::CZ19B1 TERM + ZM-WOX2A PRO::MO-CRE EXON1:ST-LS1 INTRON2::MO-CRE EXON2::PINII + SB-UBI PRO::ZS-GREEN1::PINII TERM::OS-UBI TERM + LOXP + SB-ALS PRO:: HRA::PINII TERM-LB (SEQ ID NO: 74) |
| PHP24600 | RB + CAMV35S TERM:: PAT:: CAMVS PRO+ UBIZM PRO:: DS-RED:: PINII TERM + LB (SEQ ID NO: 69) |
| PHP79530 | RB + LOXP + NOS PRO::OS-WUS::IN2-1 TERM + SB-UBI PRO::SB-UBI-INTRON1::OS-ODP2::SB-UBI TERM + GZ-W64A TERM + UBI1ZM PRO::UBI1ZM INTRON1::ZS-GREEN1::PINII TERM + SB-ACTIN TERM + LOXP + SB-ALS PRO::ZM-ALS::PINII TERM + LB (SEQ ID NO: 70) |
| PHP79531 | RB + LOXP + NOS PRO::SI-WUS::IN2-1 TERM + SB-UBI PRO::SB-UBI-INTRON1::SI-ODP2::SB-UBI TERM + GZ-W64A TERM + UBI1ZM PRO::UBI1ZM INTRON1::ZS-GREEN1::PINII TERM + SB-ACTIN TERM + LOXP + SB-ALS PRO::ZM-ALS::PINII TERM + LB (SEQ ID NO: 71) |
| PHP80911 | RB + LOXP + NOS PRO::ZM-WUS2::IN2-1 TERM + SB-UBI PRO::SB-UBI-INTRON1::ZM-ODP2::SB-UBI TERM + GZ-W64A TERM + UBI1ZM PRO::UBI1ZM INTRON1::ZS-GREEN1::PINII TERM + SB-ACTIN TERM + LOXP + SB-ALS PRO::ZM-ALS::PINII TERM + LB (SEQ ID NO: 72) |
| PHP80912 | RB + ZM-PLTP PRO::ZM-ODP2::OS-T28 TERM + SB-ALS PRO::ZM-ALS::SB-PEPC1 TERM + LTP2 PRO::ZS-YELLOWN1::PINII TERM + LB (SEQ ID NO: 53) |
| PHP80913 | RB + ZM-AXIG1 PRO::ZM-WUS2::IN2-1 TERM + SB-ALS PRO::ZM-ALS::SB-PEPC1 TERM + LTP2 PRO::ZS-YELLOWN1::PINII TERM + LB (SEQ ID NO: 54) |
| RV003866 | RB- UBI PRO:UBI1ZM INTRON::MO-FLP::PINII TERM + CaMV35S TERM + FRT1::PMI::PINII TERM + ZM-AXIG1 PRO::ZM-WUS2::IN2-1 TERM + ZM-PLTP PRO::ZM-ODP2::OS-T28 TERM + UBI PRO::UBI1ZM INTRON::DsRED:FRT87-LB (SEQ ID NO: 89) |

TABLE 1-continued

Plasmid Components.

| Plasmid ID | T-DNA |
|---|---|
| RV004886 | RB- + ZM-AXIG1 PRO::ZM-WUS2::IN2-1 TERM + ZM-PLTP PRO::ZM-ODP2::OS-T28 TERM+ UBI PRO:: UBI1ZM INTRON::MO-FLP::PINII TERM + CaMV35S TERM + FRT1::PMI::PINII TERM + UBI PRO::UBI1ZM INTRON::DsRED: FRT87-LB (SEQ ID NO: 90) |
| RV012587 | RB + ZM-PLTP PRO::ZM-LEC1::IN2-1 TERM + ZM-PLTP PRO::ZM-ODP2:: OS-T28 TERM + SB-UBI PRO:SB-UBI INTRON1::ZS-GREEN1::OS-UBI TERM + SB-ALS PRO:: HRA::PINII TERM + LB (SEQ ID NO: 91) |
| RV012588 | RB + ZM-AXIG1 PRO::ZM-WUS2::IN2-1 TERM + ZM-PLTP PRO::ZM-LEC1:: OS-T28 TERM + SB-UBI PRO::SB-UBI INTRON1::ZS-GREEN1::OS-UBI TERM + SB-ALS PRO:: HRA::PINII TERM + LB (SEQ ID NO: 92) |
| RV012589 | RB + ZM-CAB7 PRO::ZM-WUS2::IN2-1 TERM + ZM-PLTP PRO::ZM-ODP2:: OS-T28 TERM + SB-UBI PRO::SB-UBI INTRON1::ZS-GREEN1::OS-UBI TERM + SB-ALS PRO:: HRA::PINII TERM + LB (SEQ ID NO: 93) |
| RV012590 | RB + ZM-UVBR PRO::ZM-WUS2::IN2-1 TERM + ZM-PLTP PRO::ZM-ODP2:: OS-T28 TERM + SB-UBI PRO::SB-UBI INTRON1::ZS-GREEN1::OS-UBI TERM + SB-ALS PRO:: HRA::PINII TERM + LB (SEQ ID NO: 94) |
| RV012591 | RB + ZM-AXIG1 PRO::ZM-WUS2::IN2-1 TERM + SB-PLTP1 PRO::ZM-ODP2:: OS-T28 TERM + SB-UBI PRO:SB-UBI INTRON1::ZS-GREEN1::OS-UBI TERM + SB-ALS PRO:: HRA::PINII TERM + LB (SEQ ID NO: 95) |
| RV012592 | RB + ZM-AXIG1 PRO::ZM-WUS2::IN2-1 TERM + SI-PLTP1 PRO::ZM-ODP2:: OS-T28 TERM + SB-UBI PRO::SB-UBI INTRON1::ZS-GREEN1::OS-UBI TERM + SB-ALS PRO:: HRA::PINII TERM + LB (SEQ ID NO: 96) |
| RV012593 | RB + ZM-AXIG1 PRO::ZM-WUS2::IN2-1 TERM + ZM-PLTP1 PRO::ZM-ODP2:: OS-T28 TERM + SB-UBI PRO:SB-UBI INTRON1::ZS-GREEN1::OS-UBI TERM + SB-ALS PRO:: HRA::PINII TERM + LB (SEQ ID NO: 97) |
| RV012594 | RB + ZM-AXIG1 PRO::ZM-WUS2::IN2-1 TERM + ZM-PLTP2 PRO::ZM-ODP2:: OS-T28 TERM + SB-UBI PRO::SB-UBI INTRON1::ZS-GREEN1::OS-UBI TERM + SB-ALS PRO:: HRA::PINII TERM + LB (SEQ ID NO: 98) |
| RV012595 | RB + ZM-AXIG1 PRO::ZM-WUS2::IN2-1 TERM + OS-PLTP1 PRO::ZM-ODP2:: OS-T28 TERM + SB-UBI PRO:SB-UBI INTRON1::ZS-GREEN1::OS-UBI TERM + SB-ALS PRO:: HRA::PINII TERM + LB (SEQ ID NO: 99) |
| RV012603 | RB + ZM-AXIG1 PRO::ZM-WOX2A::IN2-1 TERM + ZM-PLTP PRO::ZM-ODP2:: OS-T28 TERM + SB-UBI PRO:SB-UBI INTRON1::ZS-GREEN1::OS-UBI TERM + SB-ALS PRO:: HRA::PINII TERM + LB (SEQ ID NO: 100) |
| RV012604 | RB + ZM-AXIG1 PRO::ZM-WOX4::IN2-1 TERM + ZM-PLTP PRO::ZM-ODP2:: OS-T28 TERM + SB-UBI PRO:SB-UBI INTRON1:ZS-GREEN1::OS-UBI TERM + SB-ALS PRO:: HRA::PINII TERM + LB (SEQ ID NO: 101) |
| RV012605 | RB + ZM-AXIG1 PRO::ZM-WOX5A::IN2-1 TERM + ZM-PLTP PRO::ZM-ODP2:: OS-T28 TERM + SB-UBI PRO::SB-UBI INTRON1::ZS-GREEN1::OS-UBI TERM + SB-ALS PRO:: HRA::PINII TERM + LB (SEQ ID NO: 102) |
| RV012606 | RB + ZM-AXIG1 PRO::SB-WUS1::IN2-1 TERM + ZM-PLTP PRO::ZM-ODP2:: OS-T28 TERM + SB-UBI PRO:SB-UBI INTRON1::ZS-GREEN1::OS-UBI TERM + SB-ALS PRO:: HRA::PINII TERM + LB (SEQ ID NO: 103) |
| RV012608 | RB + ZM-AXIG1 PRO::ZM-WUS2::IN2-1 TERM + ZM-PLTP PRO::ZM-ODP2:: OS-T28 TERM + SB-UBI PRO::SB-UBI INTRON1::ZS-GREEN1::OS-UBI TERM + SB-ALS PRO:: HRA::PINII TERM + LB (SEQ ID NO: 104) |
| PHP80730 | OVERDRIVE + RB (OCTOPINE) + GM-LTP3 PRO::AT-WUS::UBQ14 TERM + GM-UBQ PRO::GM-UBQ INTRON1::TAG-RFP::UBQ3 TERM + GM-SAMS PRO::GM-SAMS INTRON1::GM-HRA::GM-ALS TERM + LB (OCTOPINE) + LB (AGROPINE) + LB (SEQ ID NO: 105) |

Example 2: Culture Media

Various media are referenced in the Examples for use in transformation and cell culture. Media compositions are described below in Tables 2-9.

TABLE 2

Culture media for *sorghum* transformation.
Medium Composition

PHI-I: 4.3 g/l MS salts (Phytotechnology Laboratories, Shawnee Mission, KS, catalog number M524), 0.5 mg/l nicotinic acid, 0.5 mg/l pyridoxine HCl, 1 mg/l thiamine HCl, 0.1 g/l myo-inositol, 1 g/l casamino acids (Becton Dickinson and Company, BD Diagnostic Systems, Sparks, MD, catalog number 223050), 1.5 mg/l 2,4-dichlorophenoxyacetic acid (2,4-D), 68.5 g/l sucrose, 36 g/l glucose, pH 5.2; with 100 µM acetosyringone added before using.
PHI-T: PHI-I with 20 g/l sucrose, 10 g/l glucose, 2 mg/l 2,4-D, no casamino acids, 0.5 g/l MES buffer, 0.7 g/l L-proline, 10 mg/l ascorbic acid, 100 µM acetosyringone, 8 g/l agar, pH 5.8.
PHI-U: PHI-T with 1.5 mg/l 2,4-D 100 mg/l carbenicillin, 30 g/l sucrose, no glucose and acetosyringone; 5 mg/l PPT, pH 5.8.
PHI-UM: PHI-U with 12.5 g/l mannose and 5 g/l maltose, no sucrose, no PPT, pH 5.8
PHI-V: PHI-U with 10 mg/l PPT
DBC3: 4.3 g/l MS salts, 0.25 g/l myo-inositol, 1.0 g/l casein hydrolysate, 1.0 mg/l thiamine HCL, 1.0 mg/l 2,4-D, 30 g/l maltose, 0.69 g/l L-proline, 1.22 mg/l cupric sulfate, 0.5 mg/l BAP (6-benzylaminopurine), 3.5 g/l phytagel, pH 5.8
PHI-X: 4.3 g/l MS salts, 0.1 g/l myo-inositol, 5.0 ml MS vitamins stock[b], 0.5 mg/l zeatin, 700 mg/l L-proline, 60 g/l sucrose, 1 mg/l indole-3-acetic acid, 0.1 µM abscisic acid, 0.1 mg/l thidiazuron, 100 mg/l carbenicillin, 5 mg/l PPT, 8 g/l agar, pH 5.6.
PHI-XM: PHI-X with no PPT; added 1.25 mg/l cupric sulfate, pH 5.6.
PHI-Z: 2.15 g/l MS salts, 0.05 g/l myo-inositol, 2.5 ml MS vitamins stock[b], 20 g/l sucrose, 3 g/l phytagel, pH 5.6

[a]PHI-I, PHI-T, PHI-U, PHI-V, PHI-X, and PHI-Z media from Zhao et al. 2000
[b]MS vitamins stock: 0.1 g/l nicotinic acid, 0.1 g/l pyridoxine HCl, 0.02 g/l thiamine HCl, 0.4 g/l glycine.

TABLE 3

Composition of wheat liquid infection medium WI 4.
WI 4

| | |
|---|---|
| DI water | 1000 mL |
| MS salt + Vitamins(M519) | 4.43 g |
| Maltose | 30 g |
| Glucose | 10 g |
| MES | 1.95 g |
| 2,4-D (.5 mg/L) | 1 ml |
| Picloram (10 mg/ml) | 200 µl |
| BAP (1 mg/L) | .5 ml |
| Adjust PH to 5.8 with KOH | |
| Post sterilization add: | |
| Acetosyringone (400 µM) | 400 µl |

TABLE 4

Composition of wheat co-cultivation medium WC#10.
WC # 10

| | |
|---|---|
| DI water | 1000 mL |
| MS salt + Vitamins(M519) | 4.43 g |
| Maltose | 30 g |
| Glucose | 1 g |
| MES | 1.95 g |
| 2,4-D (.5 mg/L) | 1 µl |
| Picloram (10 mg/ml) | 200 µl |
| BAP (1 mg/L) | .5 ml |
| 50X CuSO4 (.1M) | 49 µl |

TABLE 4-continued

Composition of wheat co-cultivation medium WC#10.
WC # 10

| | |
|---|---|
| Adjust PH to 5.8 with KOH and add 2.5 g/L of Phytagel. | |
| Post sterilization add: | |
| Acetosyringone (400 µM) | 400 µl |

TABLE 5

Composition of wheat Green Tissue culture medium DBC4.
DBC4

| | |
|---|---|
| dd H20 | 1000 mL |
| MS salt | 4.3 g |
| Maltose | 30 g |
| Myo-inositol | 0.25 g |
| N-Z-Amine-A | 1 g |
| Proline | 0.69 g |
| Thiamine-HCl (0.1 mg/mL) | 10 mL |
| 50X CuSO4 (0.1M) | 49 µL |
| 2,4-D (0.5 mg/mL) | 2 mL |
| BAP | 1 mL |
| Adjust PH to 5.8 with KOH and then add 3.5 g/L of Phytagel. | |
| Post sterilization add: | |
| Cef(100 mg/ml) | 1 ml |

TABLE 6

Composition of wheat Green Tissue induction medium DBC6.
DBC6

| | |
|---|---|
| dd H20 | 1000 mL |
| MS salt | 4.3 g |
| Maltose | 30 g |
| Myo-inositol | 0.25 g |
| N-Z-Amine-A | 1 g |
| Proline | 0.69 g |
| Thiamine-HCl (0.1 mg/mL) | 10 mL |
| 50X CuSO4 (0.1M) | 49 µL |
| 2,4-D (0.5 mg/mL) | 1 mL |
| BAP | 2 mL |
| Adjust PH to 5.8 with KOH and then add 3.5 g/L of Phytagel. | |
| Post sterilization add: | |
| Cef(100 mg/ml) | 1 ml |

TABLE 7

Composition of wheat regeneration medium MSA.
MSA

| | |
|---|---|
| dd H20 | 1000 mL |
| MS salt + Vitamins(M519) | 4.43 g |
| Sucrose | 20 g |
| Myo- Inositol | 1 g |
| Adjust PH to 5.8 with KOH and then add 3.5 g/L of Phytagel. | |
| Post steriliaztion add: | |
| Cef(100 mg/ml) | 1 ml |

TABLE 8

Composition of wheat regeneration medium MSB.
MSB

| | |
|---|---|
| dd H20 | 1000 mL |
| MS salt + Vitamins(M519) | 4.43 g |
| Sucrose | 20 g |
| Myo- Inositol | 1 g |
| Adjust PH to 5.8 with KOH and then add 3.5 g/L of Phytagel. | |
| Post steriliaztion add: | |
| Cef(100 mg/ml) | 1 ml |
| IBA | .5 ml |

TABLE 9

Media formations for maize transformation, selection and regeneration.

| Medium components | Units per liter | 12V | 810I | 700 | 710I | 605J | 605T | 289Q |
|---|---|---|---|---|---|---|---|---|
| MS BASAL SALT MIXTURE | g | | | 4.3 | 4.3 | 4.3 | 4.3 | 4.3 |
| N6 MACRONUTRIENTS 10X | ml | | | | | 60.0 | 60.0 | |
| POTASSIUM NITRATE | g | | | | | 1.7 | 1.7 | |
| B5H MINOR SALTS 1000X | ml | | | | | 0.6 | 0.6 | |
| NaFe EDTA FOR B5H 100X | ml | | | | | 6.0 | 6.0 | |
| ERIKSSON'S VITAMINS 1000X | ml | | | | | 0.4 | 0.4 | |
| S&H VITAMIN STOCK 100X | ml | | | | | 6.0 | 6.0 | |
| THIAMINE•HCL | mg | | | 10.0 | 10.0 | 0.5 | 0.5 | |
| L-PROLINE | g | | | | 0.7 | 2.0 | 2.0 | 0.7 |
| CASEIN HYDROLYSATE (ACID) | g | | | | | 0.3 | 0.3 | |
| SUCROSE | g | | | 68.5 | 20.0 | 20.0 | 20.0 | 60.0 |
| GLUCOSE | g | 5.0 | | 36.0 | 10.0 | 0.6 | 0.6 | |
| MALTOSE | g | | | | | | | |
| 2,4-D | mg | | | 1.5 | 2.0 | 0.8 | 0.8 | |
| AGAR | g | 15.0 | 15.0 | | 8.0 | 6.0 | 6.0 | 8.0 |
| PHYTAGEL | g | | | | | | | |
| DICAMBA | g | | | | | 1.2 | 1.2 | |
| SILVER NITRATE | mg | | | | | 3.4 | 3.4 | |
| AGRIBIO Carbenicillin | mg | | | | | 100.0 | | |
| Timentin | mg | | | | | | 150.0 | 150.0 |
| Cefotaxime | mg | | | | | | 100.0 | 100.0 |
| MYO-INOSITOL | g | | | 0.1 | 0.1 | | | 0.1 |
| NICOTINIC ACID | mg | | | 0.5 | 0.5 | | | |
| PYRIDOXINE•HCL | mg | | | 0.5 | 0.5 | | | |
| VITAMIN ASSAY CASAMINO ACIDS | g | | | 1.0 | | | | |
| MES BUFFER | g | | | | 0.5 | | | |
| ACETOSYRINGONE | uM | | | | 100.0 | | | |
| ASCORBIC ACID 10 MG/ML (7S) | mg | | | | 10.0 | | | |
| MS VITAMIN STOCK SOL. | ml | | | | | | | 5.0 |
| ZEATIN | mg | | | | | | | 0.5 |
| CUPRIC SULFATE | mg | | | | | | | 1.3 |
| IAA 0.5 MG/ML (28A) | ml | | | | | | | 2.0 |
| ABA 0.1 mm | ml | | | | | | | 1.0 |
| THIDIAZURON | mg | | | | | | | 0.1 |
| AGRIBIO Carbenicillin | mg | | | | | | | 100.0 |
| PPT(GLUFOSINATE-NH4) | mg | | | | | | | |
| BAP | mg | | | | | | | 1.0 |
| YEAST EXTRACT(BD Difco) | g | | 5.0 | | | | | |
| PEPTONE | g | | 10.0 | | | | | |
| SODIUM CHLORIDE | g | | 5.0 | | | | | |
| SPECTINOMYCIN | mg | 50.0 | 100.0 | | | | | |
| FERROUS SULFATE•7H20 | ml | 2.0 | | | | | | |
| AB BUFFER 20X (12D) | ml | 50.0 | | | | | | |
| AB SALTS 20X (12E) | ml | 50.0 | | | | | | |
| Benomyl | mg | | | | | | | |
| pH | | | | | | | | 5.6 |

| Medium components | Units per liter | 289R | 13158H | 13224B | 13266K | 272X | 272V | 13158 |
|---|---|---|---|---|---|---|---|---|
| MS BASAL SALT MIXTURE | g | 4.3 | 4.3 | | 4.3 | 4.3 | 4.3 | 4.3 |
| N6 MACRONUTRIENTS 10X | ml | | | 4.0 | 60.0 | | | |
| POTASSIUM NITRATE | g | | | | 1.7 | | | |
| B5H MINOR SALTS 1000X | ml | | | | 0.6 | | | |
| NaFe EDTA FOR B5H 100X | ml | | | | 6.0 | | | |

TABLE 9-continued

Media formations for maize transformation, selection and regeneration.

| Component | Unit | | | | | | | |
|---|---|---|---|---|---|---|---|---|
| ERIKSSON'S VITAMINS 1000X | ml | | | 1.0 | 0.4 | | | |
| S&H VITAMIN STOCK 100X | ml | | | | 6.0 | | | |
| THIAMINE•HCL | mg | | | 0.5 | 0.5 | | | |
| L-PROLINE | g | 0.7 | 0.7 | 2.9 | 2.0 | | | |
| CASEIN HYDROLYSATE (ACID) | g | | | | 0.3 | | | |
| SUCROSE | g | 60.0 | 60.0 | 190.0 | 20.0 | 40.0 | 40.0 | 40.0 |
| GLUCOSE | g | | | | 0.6 | | | |
| MALTOSE | g | | | | | | | |
| 2,4-D | mg | | | | 1.6 | | | |
| AGAR | g | | 8.0 | 6.4 | 6.0 | 6.0 | 6.0 | 6.0 |
| PHYTAGEL | g | | | | | | | |
| DICAMBA | g | | | | 1.2 | | | |
| SILVER NITRATE | mg | | | 8.5 | 1.7 | | | |
| AGRIBIO Carbenicillin | mg | | | | 2.0 | | | |
| Timentin | mg | 150.0 | 150.0 | | | | | |
| Cefotaxime | mg | 100.0 | 100.0 | 25 | 25 | | | |
| MYO-INOSITOL | g | 0.1 | 0.1 | | | 0.1 | 0.1 | 0.1 |
| NICOTINIC ACID | mg | | | | | | | |
| PYRIDOXINE•HCL | mg | | | | | | | |
| VITAMIN ASSAY CASAMINO ACIDS | g | | | | | | | |
| MES BUFFER | g | | | | | | | |
| ACETOSYRINGONE | uM | | | | | | | |
| ASCORBIC ACID 10 MG/ML (7S) | mg | | | | | | | |
| MS VITAMIN STOCK SOL. | ml | 5.0 | 5.0 | | | 5.0 | 5.0 | 5.0 |
| ZEATIN | mg | 0.5 | 0.5 | | | | | |
| CUPRIC SULFATE | mg | 1.3 | 1.3 | | | | | |
| IAA 0.5 MG/ML (28A) | ml | 2.0 | 2.0 | | | | | |
| ABA 0.1 mm | ml | 1.0 | 1.0 | | | | | |
| THIDIAZURON | mg | 0.1 | 0.1 | | | | | |
| AGRIBIO Carbenicillin | mg | | | | | | | |
| PPT(GLUFOSINATE-NH4) | mg | | | | | | | |
| BAP | mg | | | | | | | |
| YEAST EXTRACT (BD Difco) | g | | | | | | | |
| PEPTONE | g | | | | | | | |
| SODIUM CHLORIDE | g | | | | | | | |
| SPECTINOMYCIN | mg | | | | | | | |
| FERROUS SULFATE•7H2O | ml | | | | | | | |
| AB BUFFER 20X (12D) | ml | | | | | | | |
| AB SALTS 20X (12E) | ml | | | | | | | |
| Benomyl | mg | | | | | | 100.0 | |
| pH | | | | 0.5 | 5.6 | | | |

Example 3: Particle Bombardment

Prior to bombardment, 10-12 DAP immature embryos were isolated from ears of the Pioneer inbred PH184C and placed on culture medium plus 16% sucrose for three hours to plasmolyze the scutellar cells.

Four plasmids were typically used for each particle bombardment; 1) the donor plasmid (100 ng/µl) containing the FRT-flanked donor cassette for Recombinase-Mediated Cassette Exchange, 2) a plasmid (2.5 ng/µl) containing the expression cassette UBI PRO::FLPm::PinII, 3) a plasmid (10 ng/µl) containing the expression cassette UBI PRO::ODP2::PinII, and 4) a plasmid (5 ng/ul) containing the expression cassette UBI::WUS2::PinII. To attach the DNA to 0.6 µm gold particles, the four plasmids were mixed by adding 10 µl of each plasmid together in a low-binding microfuge tube (Sorenson Bioscience 39640T) for a total of 40 µl. To this suspension, 50 µl of 0.6 µm gold particles (30 µg/µl) and 1.0 µl of Transit 20/20 (Cat No MIR5404, Mirus Bio LLC) were added, and the suspension was placed on a rotary shaker for 10 minutes. The suspension was centrifuged at 10,000 RPM (~9400×g) and the supernatant was discarded. The gold particles were re-suspended in 120 µl of 100% ethanol, briefly sonicated at low power and 10 µl was pipetted onto each flier. The fliers were then air-dried to remove all the remaining ethanol. Particle bombardment was performed using a Biolistics PDF-1000, at 28 inches of Mercury using a 200 PSI rupture disc.

Example 4: *Agrobacterium*-Mediated Transformation of Corn

A. Preparation of *Agrobacterium* Master Plate.

*Agrobacterium tumefaciens* harboring a binary donor vector was streaked out from a −80° C. frozen aliquot onto solid 12V medium and cultured at 28° C. in the dark for 2-3 days to make a master plate.

B. Growing *Agrobacterium* on Solid Medium.

A single colony or multiple colonies of *Agrobacterium* were picked from the master plate and streaked onto a second plate containing 8101 medium and incubated at 28° C. in the dark for 1-2 days. *Agrobacterium* infection medium (700 medium; 5 ml) and 100 mM 3'-5'-Dimethoxy-4'-hydroxyacetophenone (acetosyringone; 5 µL) were added to a 14 mL conical tube in a hood. About 3 full loops of *Agrobacterium* from the second plate were suspended in the tube and the tube was then vortexed to make an even suspension. Suspension (1 ml) was transferred to a spectrophotometer tube and the optical density (550 nm) of the suspension was adjusted to a reading of about 0.35-2.0. The *Agrobacterium* concentration was approximately 0.5 to 2.0× $10^9$ cfu/mL. The final *Agrobacterium* suspension was aliquoted into 2 mL microcentrifuge tubes, each containing about 1 mL of the suspension. The suspensions were then used as soon as possible.

C. Growing *Agrobacterium* on Liquid Medium.

Alternatively, *Agrobacterium* can be prepared for transformation by growing in liquid medium. One day before infection, a 125 ml flask was prepared with 30 ml of 557A medium (10.5 g/l potassium phosphate dibasic, 4.5 g/l potassium phosphate monobasic anhydrous, 1 g/l ammonium sulfate, 0.5 g/l sodium citrate dehydrate, 10 g/l sucrose, 1 mM magnesium sulfate) and 30 µL spectinomycin (50 mg/mL) and 30 µL acetosyringone (20 mg/mL). A half loopful of *Agrobacterium* from a second plate was suspended into the flasks and placed on an orbital shaker set at 200 rpm and incubated at the 28° C. overnight. The *Agrobacterium* culture was centrifuged at 5000 rpm for 10 min. The supernatant was removed and the *Agrobacterium* infection medium with acetosyringone solution was added. The bacteria were resuspended by vortex and the optical density (550 nm) of *Agrobacterium* suspension was adjusted to a reading of about 0.35 to 2.0.

D. Maize Transformation.

Ears of a maize (*Zea mays* L.) cultivar were surface-sterilized for 15-20 min in 20% (v/v) bleach (5.25% sodium hypochlorite) plus 1 drop of Tween 20 followed by 3 washes in sterile water. Immature embryos (IEs) were isolated from ears and were placed in 2 ml of the *Agrobacterium* infection medium with acetosyringone solution. The optimal size of the embryos varies based on the inbred, but for transformation with WUS2 and ODP2 a wide size range of immature embryo sizes could be used. The solution was drawn off and 1 ml of *Agrobacterium* suspension was added to the embryos and the tube vortexed for 5-10 sec. The microfuge tube was allowed to stand for 5 min in the hood. The suspension of *Agrobacterium* and embryos were poured onto 710I co-cultivation medium (see Table 9). Any embryos left in the tube were transferred to the plate using a sterile spatula. The *Agrobacterium* suspension was drawn off and the embryos placed axis side down on the media. The plate was sealed with Parafilm M® film (moisture resistant flexible plastic, available at Bemis Company, Inc., 1 Neenah Center 4$^{th}$ floor, PO Box 669, Neenah, Wis. 54957) and incubated in the dark at 21° C. for 1-3 days of co-cultivation.

Embryos were transferred to resting medium (605T medium) without selection. Three to 7 days later, they were transferred to maturation medium (289Q medium) supplemented with a selective agent.

Example 5: Expression of ODP2 and WUS2

The following experiment demonstrated that expression of ODP2 and WUS2 immediately after *Agrobacterium* infection resulted in direct somatic embryogenesis.

A. The PLTP Promoter Driving ODP2 and the NOS Promoter Driving WUS2 Expression Resulted in Rapid, Direct Somatic Embryo Formation.

Immature embryos (2-2.5 mm in length) were harvested from Pioneer maize inbred PH184C approximately 11 days after pollination, and were infected with *Agrobacterium* strain AGL1 containing a T-DNA with the following composition; RB+NOS PRO::Top2::ZM-WUS2::IN2-1 TERM+ZM-PLTP PRO::ZM-ODP2::OS-T28 TERM+GZ-W64A TERM+UBI PRO::UBI1ZM INTRON::ESR::SB-SAG12 TERM+SB-ALS PRO:: HRA::SB-PEPC1 TERM+LTP2 PRO::ZS-YELLOW::PINII TERM-LB, as described in Example 3. For the PLTP PRO, see SEQ ID NO. 1. *Agrobacterium* was grown in liquid medium to an optical density of 0.5 (at 520 nm) and the immature embryos (53, 52 and 56 embryos from three separate ears) were incubated in the *Agrobacterium* suspension for 5 minutes before removal from the liquid to be placed on solid 710I medium.

Figure 2:
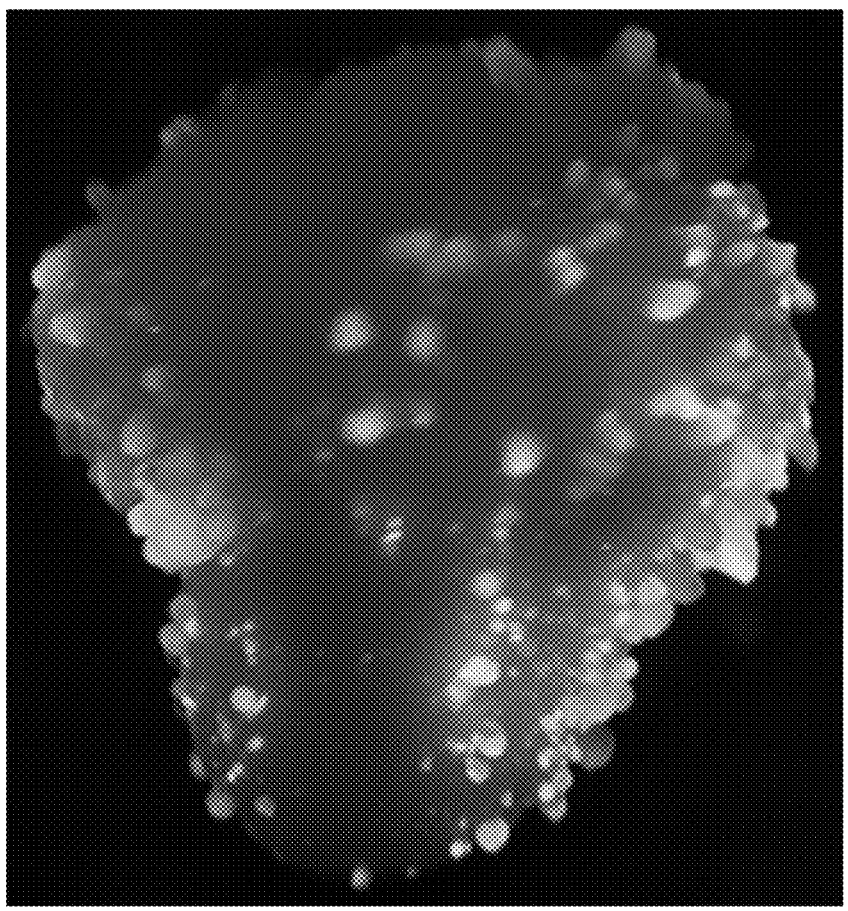
FIG. 2 shows a representative image of an immature embryo treated using the disclosed methods (see Example 5). The image shows fluorescent embryos on the surface following treatment.

After 24 hours, the embryos were moved to 605T medium to begin selection against the *Agrobacterium*. After 6 days, numerous small somatic embryos were observed on the surface of each of the 124 treated immature embryos. Each immature embryo contained numerous, distinct, individual somatic embryos, many being supported on clearly-defined suspensors. Representative embryos produced by expression of ODP2 and WUS2 are shown in FIG. 1 and FIG. 2, e.g., see arrows pointing to newly formed embryos in FIG. 1. Newly-formed fluorescent embryos are also seen in FIG. 2. The image in FIG. 1 was captured 4 days after the beginning of *Agrobacterium* infection, using a stereomicroscope with lighting from above. The overall length of the zygotic embryo is approximately 1.5 mm. The embryos shown in FIG. 2 were transformed with the AXIG1::WUS2:: IN2 and PLTP::ODP2::OS-T28 expression cassettes, along with a UBI PRO::ZS-GREEN::PINII expression cassette. The image shows fluorescent embryos growing on the scutellar surface of the originally-transformed zygotic embryo following treatment using the disclosed methods. This image was captured 4 days after the beginning of *Agrobacterium* infection, using a stereomicroscope with epifluorescence attachments and a standard Leica GFP filter set. The overall length of the zygotic embryo is approximately 1.5 mm.

Seven days after Agro-infection, the embryos were transferred to maturation medium (289Q medium with 0.1 mg/l imazapyr), using imidazolinone herbicide to select for transgenic embryos. After 14 days on the maturation medium, the mature embryos were moved onto rooting medium (13158H medium; 13158 medium plus 25 mg/l cefotaxime) and leaf pieces were sampled for PCR analysis. From the 53 embryos derived from the first ear, 12 herbicide-resistant plants were analyzed using PCR analysis and sent to the greenhouse between 32-34 days after the beginning of the experiment, which was begun when the *Agrobacterium* transformation was started. Plants were sampled for PCR by taking two samples from each plant, one from each of two opposing leaves (from opposite sides of the plant) to confirm that the plants were not chimeric. PCR results for each pair of samples from all the plants indicated that no chimeric plants were produced, and that the T0 plants were homogenously transgenic.

B. Comparing No Herbicide Selection, No Herbicide Selection with the Addition of Branched Chain Amino Acids, or Selection with Imazapyr.

Two replicates of this experiment were performed, with the only differences between the two replicates were the number of starting immature embryos and the numbers of embryos (or plants) moving on to successive stages of the experiment. For both replicates, immature embryos from the Pioneer inbred PH184C were infected with *Agrobacterium* strain AGL1 (THY−) containing the following T-DNA (from PHP77833); RB+NOS PRO::Top2::ZM-WUS2::IN2-1 TERM+ZM-PLTP PRO::ZM-ODP2::OS-T28 TERM+GZ-W64A TERM+UBI PRO:UBI1ZM INTRON:ESR::SB-SAG12 TERM+SB-ALS PRO:: HRA::SB-PEPC1 TERM+LTP2 PRO::ZS-YELLOW::PINII TERM-LB. After a 5 minute infection in the liquid *Agrobacterium* suspension, the immature embryos were transferred to solid culture medium (2701 media) overnight. The following day the embryos were moved onto one of three media, 605T; 605T with 0.1 mg/l ethametsulfuron (also containing the herbicide imazapyr (0.1 mg/1) for selection) plus branched chain amino acids (abbreviated as "AA", containing 100 mM leucine, isoleucine, or valine); or 605T with 0.1 mg/l ethametsulfuron (also containing the herbicide imazapyr (0.1 mg/1) for selection) with no branched-chain amino acids. Embryos were moved to maturation medium 12 days later, with embryos from 605T medium being transferred to 289Q medium with 0.1 mg/l imazapyr (selection during maturation), embryos from medium 605T medium with 0.1 mg/l ethametsulfuron with AA being transferred to 289Q medium (early selection but no selection during maturation), and embryos from medium 605T with 0.1 mg/l ethametsulfuron moving onto 289Q medium (early selection). Sixteen days later, embryos with healthy somatic embryos were moved onto regeneration medium 272V medium.

For the first replicate of this experiment, 206 embryos were treated with *Agrobacterium* and one day later 106, 67, or 33 embryos were moved onto 605T medium (no selection for the first week), 605T medium with 0.1 mg/l ethametsulfuron with AA (early selection with AA) or 605T medium with 0.1 mg/l ethametsulfuron (early selection with no AA), respectively. For the next transfer, 45, 16 and 0 embryos were moved onto their respective maturation media. For the final transfer to rooting medium, 18, 10 and 0 plantlets (individual events) were moved. Of these events, 16 and 10 were sampled for PCR and 6 and 2 plants were found to be single copy for the integrated transgenes, with 0 and 2 escapes (wild-type plants that survived the selection process) were observed, respectively. For this replicate of the experiment, the total elapsed time from *Agrobacterium* infection to the greenhouse was 48 days. These results indicated that early selection with no continued selection into embryo maturation allowed wild-type escapes to survive (along with some transgenic events). However, early selection without supplemental branched-chain amino acids appeared to be stressful during the stage when the somatic embryos were forming and thus no events were produced. Starting selection at the beginning of the maturation stage was the most effective for event recovery with no escapes.

For the second replicate, a total of 196 embryos were treated with *Agrobacterium* in liquid for 5 minutes and then co-cultured for one day on 710I medium. At this point, 94, 66 or 36 embryos were moved onto 605T medium, 605T medium with 0.1 mg/l ethametsulfuron with AA or 605T medium with 0.1 mg/l ethametsulfuron, respectively. Twelve days later, the 94 embryos on 605T were split (47 each) onto either 289Q medium with 0.1 mg/l imazapyr or onto 289Q medium with 0.5 mg/l imazapyr. The embryos from both the 605T medium with 0.1 mg/l ethametsulfuron with AA and 605T medium with 0.1 mg/l ethametsulfuron were moved onto 289Q (no further selection). After maturation, healthy plantlets (events) were transferred to rooting medium 13158H, with 14, 11, 13 and 0 events being moved from the above four maturation treatments, respectively. Ultimately, 4, 5 and 2 plants were sent to the greenhouse for the three treatments from which events were recovered, and only one single-copy event was produced from the 0.5 mg/l imazapyr selection during maturation.

C. Comparing Two Promoters, ZM-PLTP PRO::Top1 and the DR5 PRO::Top3, Driving Expression of ODP2.

For both treatments, immature embryos from Pioneer inbred PH184C were harvested, treated with *Agrobacterium* strain AGL1 (THY–) containing the respective plasmids, were transferred onto 605T medium after one day on co-cultivation medium 710I with the *Agrobacterium*, were cultured on 605T medium for 10 days, moved onto 13226D with 0.1 mg/l ethametsulfuron for two days and then transferred onto maturation medium (289Q with 0.1 mg/l imazapyr) for 13 days. After maturation, the plantlets (events) were moved onto rooting (germination) medium 13158 for ten days (rooting stage).

i. ZM-PLTP Promoter Driving ZM-ODP2 Expression.

Eighty immature embryos were treated with *Agrobacterium* containing PHP78157 (SEQ ID NO. 23). Initially, all treated immature embryos responded by rapidly producing many individual somatic embryos on the surface of each scutellum. At the end of the rooting stage, 18 plantlets were produced. A subset of ten plants were sent to the greenhouse and sampled for PCR analysis (total elapsed time to the greenhouse was 46 days). Of these ten, six were multi-copy and/or contained plasmid backbone (BB), and there were 4 escapes.

ii. DR5 Promoter Driving ODP2 Expression.

Seventy immature embryos were treated with *Agrobacterium* containing PHP78156, harboring the T-DNA containing the following: RB+NOS PRO::Top2::WUS2::IN2-1 TERM+DR5 PRO:Top3:ODP2::OS-T28 TERM+GZ-W64A TERM+UBI PRO::ESR::SB-SAG12 TERM+SB-ALS PRO:: HRA::SB-PEPC1 TERM+LTP2 PRO::ZS-YELLOW::PINII TERM-LB (SEQ ID NO: 24).

Initially, all treated immature embryos responded by rapidly producing many individual somatic embryos on the surface of each scutellum. At the end of the rooting stage, 18 plantlets were produced. A subset of 12 plants were sent to the greenhouse and sampled for PCR analysis (total elapsed time to the greenhouse was 46 days). Of these twelve plants analyzed by PCR, 6 were multi-copy/BB+, 4 were single-copy and backbone-free (BB–), and there were 2 escapes.

Example 6: ZM-PLTP::ZM-ODP2+ZM-AXIG1 PRO::ZM-WUS2

The expression of ODP2 under the control of the PLTP promoter and the expression of WUS2 under the control of the AXIG1 promoter resulted in improved plant recovery, high frequencies of plants sent to the greenhouse and higher frequency of single-copy events.

Immature embryos were harvested from two maize inbreds (HC69 and PH184C) and were infected with *Agrobacterium* (strain LBA4404 THY–) containing either PHP79023 (SEQ ID NO.: 25) or PHP79024 (SEQ ID NO.: 26). For inbred HC69, 67 immature embryos were transformed with PHP79024, ultimately producing 26 plants that were resistant to 0.1 mg/l imazapyr (38.8% frequency relative to the number of starting embryos). By comparison, when 65 HC69 embryos were transformed with PHP79023, 10 herbicide-resistant plants were sent to the greenhouse (15.4% frequency). In addition, the plants produced using PHP79024 were more vigorous and healthier in the greenhouse. Transgenic plants from both starting plasmids were sent to the greenhouse 33 days after infection with *Agrobacterium*.

For inbred PH184C, 64 immature embryos were transformed with PHP79024, ultimately producing 30 plants that were resistant to 0.1 mg/l imazapyr (46.8% frequency relative to the number of starting embryos). By comparison, when 73 PH184Cembryos were transformed with PHP79023, 27 herbicide-resistant plants were sent to the greenhouse (37% frequency). In addition, the plants produced using PHP79024 were more vigorous and healthier in the greenhouse. Transgenic plants from both starting plasmids were sent to the greenhouse 33 days after infection with *Agrobacterium*. Thus for both inbreds, using the DR5 promoter to drive expression of WUS2 (along with PLTP PRO::ODP2) rapidly produced transgenic somatic embryos that could be germinated into transgenic T0 plants, but the combination of AXIG1 PRO::WUS2+PLTP PRO::ODP2 was even more effective, both in terms of the overall frequency of transgenic plant production but also in terms of T0 vigor and health in the greenhouse.

Example 7: Separation of Somatic Embryos from the Supporting Scutellum

Figure 3:
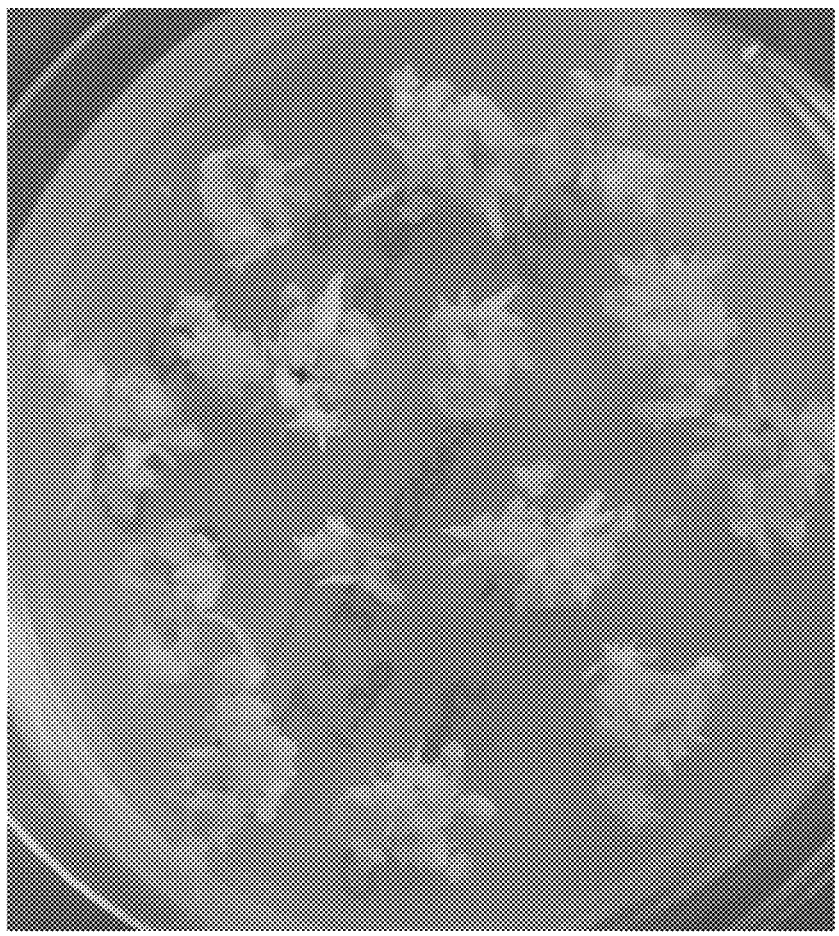
FIG. 3 shows a representative image of multiple mature somatic embryos derived from a single original zygotic immature embryo obtained using the disclosed methods (see Example 7) after growth on maturation medium for 13 days.
Figure 4:
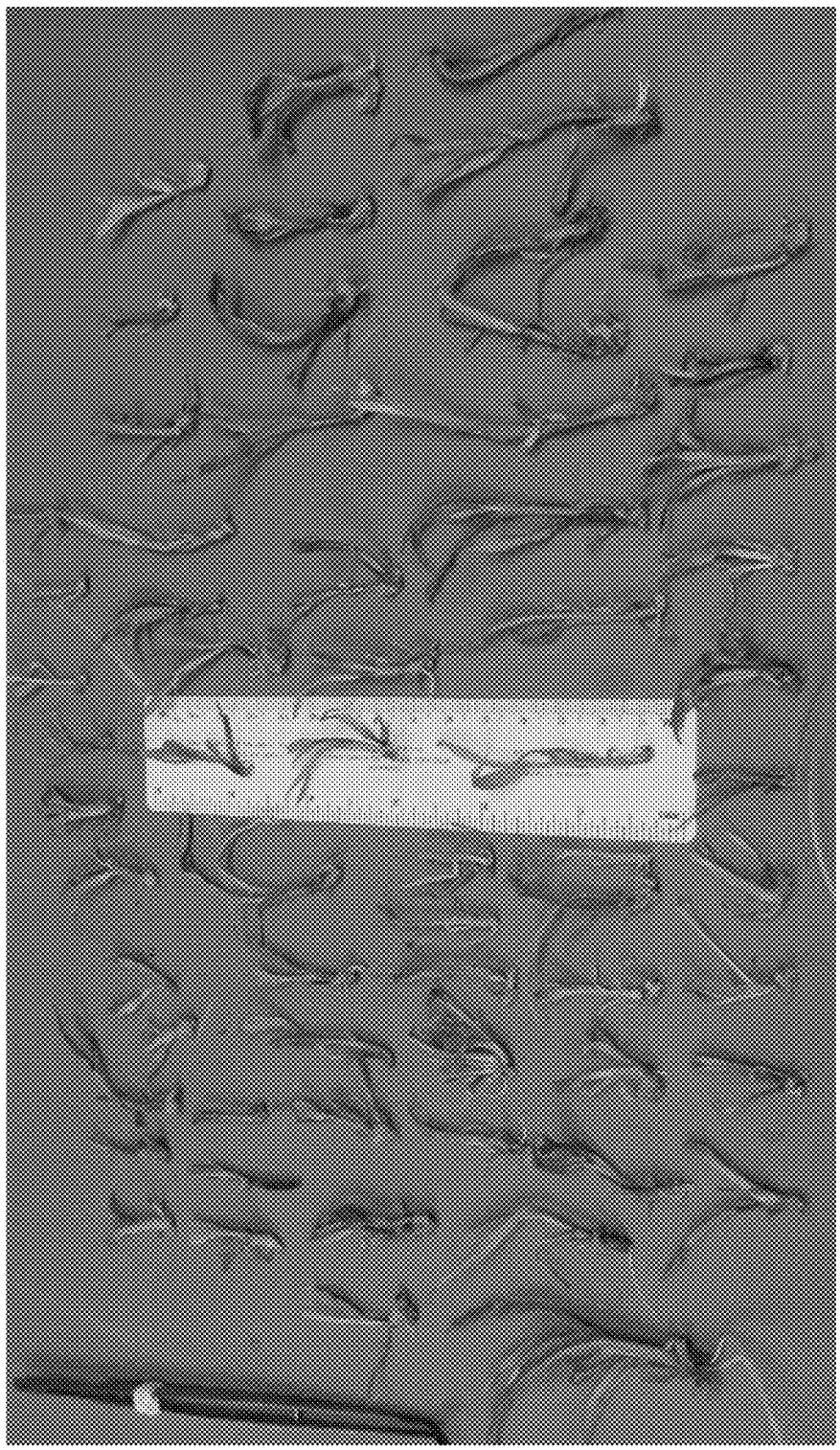
FIG. 4 shows a representative image of plants obtained from 45 originally-transformed zygotic immature embryos using the disclosed methods (see Example 7).

The recovery of independent transgenic plants was improved by separation of somatic embryos from the supporting scutellum of the original zygotic immature embryos. Immature embryos from Pioneer inbred PHH5G were transformed using *Agrobacterium* strain AGL1 (THY−) harboring the plasmid PHP79066 (SEQ ID NO.: 28) (see Table 1). After co-cultivation of 45 immature embryos with *Agrobacterium* on medium 710I for one day, the immature embryos were moved onto resting medium (605T medium) with no selection for 12 days. The embryos were moved onto maturation medium for 13 days, and multiple mature somatic embryos were clearly observed as being derived from a single original zygotic immature embryo (FIG. 3). At this point, the embryos were removed from solid medium and placed in a liquid culture (289R medium). The tube containing the suspended corn tissue was then vortexed on high power for 30-60 seconds, visually inspecting the suspension every 10-15 seconds until it appeared that the tissue was dispersed. The liquid suspension was then poured onto solid rooting medium (13158H medium with 0.1 mg/l imazapyr herbicide) and the liquid was pipetted off the plate. From this material, over 200 plants were produced (representative plants shown in FIG. 4), which resulted in an average of 4.4 plants being recovered for every starting embryo that was transformed. Of the approximately 200 T0 plants, 152 were sampled for PCR analysis, all were transformed based on PCR results (no escapes) and 43 plants were single copy for the transgenes with no Agro backbone (28.3% single-copy no BB). Based on this frequency, the total number of recovered T0 plants and the starting number of embryos, the production of quality, usable T0 events (single-copy, no backbone) was over 100% based on the number of starting embryos.

Example 8: Cre-Mediated Excision

A. UBL:CRE::PINII-Mediated Excision.

Immature embryos were harvested from Pioneer inbreds HC69 (293 embryos) and PH184C (241 embryos), and were transformed with *Agrobacterium* strain AGL1 (THY−) harboring the plasmid PHP80334 (SEQ ID NO.: 42) containing the genetic elements shown in Table 1. After 5 minutes exposure to the *Agrobacterium* in liquid medium 710I, the embryos were plated out onto agar-solidified 710I medium for overnight co-cultivation. After one day of co-cultivation, embryos were moved onto resting medium (605T with no selection) for 7 days, transferred to maturation medium (289Q with 0.1 mg/l imazapyr) for 14 days, and then were moved onto rooting (germination) medium for at least 14 days before moving the plants to the greenhouse. Based on the original number of embryos transformed, 19.1% and 13.8% of the original embryos produced a transgenic plant in HC69 and PH184C, respectively. To determine the excision frequency, seven PCR reactions were performed to test for the absence of the CRE, WUS2, ODP2, ZS-GREEN1 and ESR expression cassettes (i.e., all polynucleotide segments that were originally between the two LOXP sites in the T-DNA) and the presence of the HRA expression cassette. PCR results revealed that 21% of the HC69 plants contained only the HRA expression cassette (conferring resistance to the herbicide imazapyr) with the segment between the two original LOXP sites having excised. Thus, these plants no longer contained the CRE, WUS2, ODP2, ZS-GREEN1 AND ESR expression cassettes. When plants were analyzed for the presence of the HRA cassette with all the other cassettes having been excised, the excision frequency for PH184C was even higher than for HC69, with 47% of the plants showing that complete, perfect excision had occurred.

A difference was observed in the early growth response when the plasmid containing UBI PRO::CRE was compared to constructs that were not designed for excision. In contrast to non-excision constructs containing AXIG1 PRO::WUS2+ PLTP PRO::ODP2, wherein somatic embryos were visible at 6 days after *Agrobacterium* infection, there were no fluorescent somatic embryos observed in the UBI PRO::CRE treatment during this interval. The ubiquitin promoter (UBI PRO) is a very strong, constitutive promoter that has been used widely over many years (Christensen and Quail, (1996) Transgenic Research 5:213-218). Due to its strength and ubiquitous expression pattern, it was anticipated that UBI PRO::CRE would begin expressing immediately upon being introduced into the cell, thus it was anticipated that the WUS and ODP2 expression cassettes could be excised before being able to stimulate somatic embryo formation. Surprisingly, however, when the original zygotic embryos were placed on maturation medium, it was observed that multiple embryos formed on what had originally been a single zygotic embryo. Maturation on the herbicide imazapyr was a very stringent selection against wild-type growth, and consistent with this, the PCR results confirmed the resultant plants were transgenic and that 60% of the single-copy T0 plants analyzed by PCR showed the occurrence of perfect excision of WUS, ODP2, CRE, ZS-GREEN1 and ESR. The T-DNA of PHP80334 contains the AXIG1 PRO::WUS2, PLTP PRO::ODP2, UBI PRO::CRE, UBI PRO::ZS-GREEN and ESR expression cassettes located within the loxP recombination sites. When this T-DNA was introduced into immature embryo cells, no green fluorescence was observed indicating that excision occurred before green fluorescence protein could accumulate to visible levels (typically less than 24 hours in a non-excised UBI PRO::ZS-GREEN expression cassette. These data show that a short pulse of WUS and ODP2 are effective for rapid de novo somatic embryo formation and germination of these somatic embryos to produce transgenic T0 plants.

B. GLB1::CRE-Mediated Excision.

Immature embryos were harvested from Pioneer inbreds PH184C, and were transformed with *Agrobacterium* strain AGL1 (THY−) harboring the plasmid PHP80338 (SEQ ID NO.: 43) containing the genetic elements shown in Table 1. Transformation, selection and plant germination methods were the same as those described for the UBI PRO::CRE experiment in Example 8-A above. PCR analysis of T0 plants demonstrated that 58% of the single-copy plants had undergone complete excision of the developmental genes (ODP2 and WUS) and CRE. Substituting promoters known to drive expression either during embryo development (LTP2, OLE, END-2) or being stimulated by stress (IN2-1) also resulted in excision of the developmental genes (ODP2, WUS2) and CRE before germination to produce transgenic T0 plants.

In a comparison of different promoters driving expression of CRE, immature embryos were harvested from either Pioneer inbred HC69 or PH184C and were transformed with *Agrobacterium*-strain LBA4404 (Thy−) harboring a plasmid containing a T-DNA with the following components; RB−loxP-AXIG1 PRO::WUS2::In2-1 TERM+PLTP PRO:: ODP2::PINII TERM+"X PRO"::CRE::OS-T28 TERM-loxP+SB-ALS PRO::ZM-HRA::PINII TERM, where "X PRO" was the maize UBI PRO, the WOX2a PRO, the IN2 PRO, the LTP2 PRO, the OLE PRO, the GLB1 PRO, the HSP17.7 PRO or the HSP26 PRO that were used to drive excision of WUS, ODP2 and CRE. After 5 minutes exposure to the *Agrobacterium* in liquid medium 710I, the embryos were plated out onto agar-solidified 710I medium for overnight co-cultivation. After the one day co-cultivation, embryos were moved onto resting medium (605T with no selection) for 7 days, transferred to maturation medium with (289Q with 0.1 mg/l imazapyr) for 14 days, and then were moved onto rooting (germination) medium for at least 14 days before moving the plants to the greenhouse.

TABLE 10

Transformation and excision frequencies for promoters driving expression of CRE recombinase.

| Inbred | Vector | Promoter driving CRE Recombinase | No. of Embryos | No. of Plants | TXN % | Excision Frequency |
|---|---|---|---|---|---|---|
| PH184C | PHP80558 | WOX2a | 140 | 56 | 40% | 0% |
| PH184C | PHP80560 | IN2 | 173 | 34 | 20% | 0% |
| PH184C | PHP80334 | UBI | 440 | 40 | 9% | 60% |
| PH184C | PHP80559 | LTP2 | 229 | 75 | 33% | 50% |
| PH184C | PHP80561 | OLE | 228 | 59 | 26% | 40% |
| PH184C | PHP80770 | GLB1 | 327 | 72 | 22% | 47% |
| HC69 | PHP81430 | HSP17.7 | 190 | 102 | 54% | 67% |
| HC69 | PHP81431 | HSP26 | 242 | 78 | 32% | 54% |

As shown in Table 10, transformation efficiencies were measured by the number of recovered T0 plants from a given number of starting immature embryos and excision frequencies are shown for WUS2, ODP2 and CRE. Table 10 also shows the number of immature embryos that were infected with *Agrobacterium*, the number of T0 plants produced, the calculated transformation frequency [(No. of T0 plants/No. of embryos infected)*100] and the final excision frequency based on PCR analysis for the presence or absence of WUS, ODP2, CRE and HRA. For inbred PH184C, no excision was observed in the negative control treatments in which the T-DNA contained either WOX2a::CRE::PINII or IN2:: CRE::PINII (PHP80558 or PHP80560, respectively). However, for treatments in which the promoter driving CRE was strongly expressed in the whole plant (UBI), were expressed strongly in developing embryos (LTP2, OLE, GLB1) or were strongly induced by heat treatment (HSP17.7, HSP26), excision frequencies ranged between 40 and 60%. For the UBI PRO, excision of WUS2 and ODP2 was rapid resulting in a reduced transformation frequency (9%) and the excision frequency as measured in the T0 plants was high at 60%. For the promoters expressed during mid- to late-embryo development (LTP2, OLE and GLB1) the transformation frequencies were higher than for UBI (33, 26 and 22%, respectively) while the excision frequencies were slightly lower than for UBI (50, 40 and 47%, respectively). The treatment in which the HSP17.7 was used to control CRE expression produced the overall best results in both categories, producing the highest transformation frequency (54%) and the highest excision frequency (67%). HSP26 produced results that were in the same range as the embryo-promoters, with transformation and excision frequencies of 32% and 54%, respectively.

When the embryo-developmental promoters were used for excision, numerous somatic embryos were observed in these treatments (similar to experiments where no excision components were present) which indicated that expression was delayed until a later stage of embryo development but when developmentally-triggered, expression was uniformly strong throughout the embryos resulting in efficient excision of WUS2, ODP2 and CRE. For the heat-responsive promoters, exposure to heat (i.e. 42° C. for two hours repeated on three consecutive days) was deferred until the embryos were moved onto maturation medium, resulting in high numbers of somatic embryos that formed rapidly after transformation, followed by later efficient excision.

Example 9: Improved Recovery of Site-Specific Recombination Events

Immature ears were harvested from PH184C and 2.0 mm immature embryos were extracted from the kernels on the day of the particle bombardment treatment. The embryos were placed on high osmotic medium (13224B medium) for three hours prior to particle bombardment. Immature embryos were bombarded with an equimolar ratio of plasmids containing the following expression cassettes; FRT1: PMI::PINII TERM:FRT87+UBI PRO:UBI1ZM INTRON:: MO-FLP::PINII TERM+ZM-PLTP PRO::ZM-ODP2::PINII TERM+ZM-AXIG1 PRO::ZM-WUS2::PINII TERM. After particle bombardment, the immature embryos remained on the high-osmotic medium overnight, and were then transferred to resting medium (13266K medium with 150 mg/l G418) for 8 days. After the resting period, the embryos were transferred to maturation medium (289O medium with 150 mg/l G418) for 21 days, and then moved onto rooting medium (272× medium with 150 mg/l G418) for 14-17 days (until the roots were large enough for transplanting into soil). At the plantlet stage, leaf tissue was sampled for PCR analysis to confirm that the genes within the flanking FRT1 and FRT87 sites of the original target locus were no longer present and that the new genes within the donor cassette had recombined into the target locus correctly—and precise RMCE (Recombinase-Mediated Cassette Exchange) events were identified. This reduced the entire SSI cycle, from transformation to having precise RMCE-derived plants in the greenhouse, down to 43-50 days, depending on how long a time was required to produce adequate roots. Alternately, an *Agrobacterium* mediated SSI method was developed using constructs with AXIG1 PRO::WUS2+PLTP PTO:: ODP2. Two T-DNAs were delivered in two separate experiments; the first T-DNA containing PMI, WUS2, ODP2 and DsRED expression cassettes within the flanking FRT1 and FRT87 recombination sites (RB−UBI PRO:UBI1ZM INTRON::MO-FLP::PINII TERM+CaMV35S TERM+ FRT1:PMI::PINII TERM+ZM-AXIG1 PRO::ZM-WUS2:: IN2-1 TERM+ZM-PLTP PRO::ZM-ODP2::OS-T28 TERM+UBI PRO::UBI1ZM INTRON::DsRED: FRT87-LB) (RV003866) and the second T-DNA containing only PMI and DsRED within the FRT1 and FRT87 sties (RB−+ ZM-AXIG1 PRO::ZM-WUS2::IN2-1 TERM+ZM-PLTP PRO::ZM-ODP2::OS-T28 TERM UBI PRO:UBI1ZM INTRON::MO-FLP::PINII TERM+CaMV35S TERM+ FRT1:PMI::PINII TERM+UBI PRO::UBI1ZM INTRON:: DsRED: FRT87-LB) (RV004886). Each of the T-DNAs were delivered via Agro-mediated transformation into target lines with FRT1-FRT87 landing sites as described in U.S.

Provisional Appln. No. 62/296,639, herein incorporated in entirety by reference. Precise RMCE events were identified using a multiplex PCR assay as described in #5907 USPSP and the data is summarized in Table 11. The use of AXIG1 PRO::WUS2+PLTP PTO::ODP2 expression cassettes for Agro SSI reduced the entire SSI process by several weeks (at least 3-4 weeks), compared to the normal transformation method for generating SSI events.

TABLE 11

Recovery of RMCE events in Agro SSI experiments using WUS2 and ODP2 expression.

| Vector | # embryos infected | # T0 plants | # RMCE | % RMCE |
|---|---|---|---|---|
| RV003866 | 859 | 42 | 6 | 0.7 |
| RV004886 | 836 | 10 | 1 | 0.1 |

Example 10: Improved Recovery of Events Containing CAS9/CRISPR-Mediated Genomic Modifications CAS9-mediated cutting of the maize genome is used to introduce single codon changes to the maize ALS2 gene. To generate ALS2 edited alleles, a 794 bp fragment of homology is cloned into a plasmid vector and two 127 nucleotide single-stranded DNA oligos are tested as repair template, containing several nucleotide changes in comparison to the native sequence. The 794 bp repair templates include a single nucleotide change which will direct editing of DNA sequences corresponding to the proline at amino acid position 165 changing to a serine (P165S), as well as three additional changes within the ALS-CR4 target site and PAM sequence. Modification of the PAM sequence within the repair template alters the methionine codon (AUG) to isoleucine (AUU), which naturally occurs in the ALS1 gene. The media used for particle bombardment, selection and regeneration are similar to those used herein. Approximately 1,000 immature embryos per treatment are bombarded with the two oligo or single plasmid repair templates, UBI PRO:UBI1ZM INTRON:CAS9::PINII, POLIII PRO:: ALS~CR4 gRNA, UBI PRO:UBI1ZM INTRON: MOPAT~DSRED::PINII TERM, ZM-PLTP PRO::ZM-ODP2::PINII TERM and ZM-AXIG1 PRO::ZM-WUS2:: PINII TERM. After particle bombardment, the immature embryos were placed on media containing 3 mg/l bialaphos to select for herbicide-resistant somatic embryos. After the resting period of 8 days, the embryos were transferred onto maturation medium with biolaphos for 21 days, and then are moved onto rooting medium for 14-17 days (until the roots were large enough for transplanting into soil). Five weeks post-transformation, two hundred (per treatment) randomly selected independent young plantlets growing on selective media were transferred to fresh bialaphos media in Plant-Con™ containers (sterile plastic containers that can accommodate plants up to 6" in height). The remaining plantlets (approximately 800 per treatment) were transferred to the solid media within PlantCons™ (presterilized plant tissue culture container available from MP Biomedicals LLC, 3 Hutton Center Drive, Suite 100, Santa Anna, Calif. 92707) containing 100 ppm of chlorosulfuron as direct selection for an edited ALS2 gene. One month later, 384 of the randomly sampled plantlets (with no selection), and seven plantlets that survived chrlorsulfuron selection were sampled for analysis. Edited ALS2 alleles were detected in 9 plantlets: two derived from the randomly-selected plantlets growing on bialaphos and generated using the 794 bp repair DNA template, and the remaining 7 derived from chlorosulfuron resistant plantlets edited using the 127 nt single-stranded oligos. Analysis of the ALS1 gene revealed only wild-type sequence confirming high specificity of the ALS-CR4 gRNA.

All nine plants containing edited ALS2 alleles were sent to the greenhouse and sampled for additional molecular analysis and progeny testing. DNA sequence analysis of ALS2 alleles confirms the presence of the P165S modification as well as the other nucleotide changes associated with the respective repair templates. T1 and T2 progeny of two T0 plants were analyzed to evaluate the inheritance of the edited ALS2 alleles. Progeny plants derived from crosses using pollen from wild type Hi-II plants were analyzed by sequencing and demonstrated sexual transmission of the edited alleles observed in the parent plant with expected 1:1 segregation ratio (57:56 and 47:49, respectively). To test whether the edited ALS sequence conferred herbicide resistance, selected four-week old segregating T1 plants with edited and wild-type ALS2 alleles were sprayed with four different concentrations of chlorsulfuron (50, 100 (1×), 200, and 400 mg/liter). Three weeks after treatment, plants with an edited allele showed normal phenotype, while plants with only wild-type alleles demonstrated strong signs of senescence. In addition, embryos isolated from seed derived from plants pollinated with wild-type HI-II pollen were germinated on media with 100 ppm of chlorsulfuron. Fourteen days after germination, plants with edited alleles showed normal height and a well-developed root system, while plants with wild-type alleles were short and did not develop roots.

In the above experiment, when ODP2 and WUS2 expression cassettes (on two separate plasmids) were not included with the plasmids containing the repair templates, Cas9, ALS-CR4 gRNA, and MoPAT-DsRED, no events were recovered after particle bombardment of 1000 immature embryos and selection on bialaphos in the Pioneer inbred PHH5G (negative control). By comparison, when plasmids containing PLTP PRO::ODP2::PINII and AXIG1 PRO:: WUS2::PINII TERM were added to the plasmid mixture for gold particle preparation and particle bombardment, events containing CAS/CRISPR-mediated gene edits to the ALS gene were recovered. After particle bombardment of approximately 1000 immature embryos from the Pioneer inbred PHH5G, over 1000 bialaphos-resistant plantlets were recovered, and of these, nine were determined to contain edits to the genomic ALS2 gene conferring resistance to the herbicide chlorsulfuron.

Example 11: High Efficiency Transformation and Rapid T0 Plant Production in Sorghum Sorghum transformation was performed using an optimized Agrobacterium-mediated protocol (Wu et al., 2014, In Vitro Cellular and Developmental Biology 50:8-14) with the methods being summarized below.

A. Sorghum Material and Transformation Process.

TX430, a non-tannin sorghum variety, was used in this study. Greenhouse temperatures averaged 29° C. during the day and 20° C. at night with a 12 h d/night photoperiod and supplemental lighting was provided by a 3:1 ratio of metal halide (1,000 W) and high-pressure sodium (1,000 W) lamps. The components of the media used in this study are listed in Table 2. The baseline transformation protocol is described in detail as "treatment C" in Zhao et al. (Plant Mol. Biol. (2000) 44:789-798). Briefly, freshly harvested sorghum immature grains were sterilized with 50% bleach and 0.1% Tween-20 for 30 min under vacuum and then rinsed with sterile water three times. The embryos were subjected to the following five sequential steps: (1) *Agrobacterium* infection: embryos were incubated in an *Agrobacterium* suspension (OD=1.0 at 550 nm) with PHI-I medium for 5 min; (2) co-cultivation: embryos were cultured on PHI-T medium following infection for 3 d at 25° C. in the dark; (3) resting: embryos were cultured on PHI-T medium plus 100 mg/l carbenicillin for 7 d at 28° C. in the dark; (4) selection: embryos were cultured on PHI-U medium for 2 wk, followed by culture on PHI-V medium for the remainder of the selection process at 28° C. in the dark, using subculture intervals of 2-3 wk; (5) regeneration: callus was cultured on PHI-X medium for 2-3 wk in the dark to stimulate shoot development, followed by culture for 1 wk under conditions of 16 h light (40-120 µE $m^{-2}$ $s^{-1}$) and 8 h dark at 25° C., and a final subculture on PHI-Z medium for 2-3 wk under lights (16 h, 40-120 µE $m^{-2}$ $s^{-1}$) to stimulate root growth. Regenerated plantlets were transplanted into soil and grown in the greenhouse (Zhao et al. 2000). To plants were self-pollinated to produce $T_1$ progeny for further analysis.

In another experiment, the embryos were subjected to the following five sequential steps: (1) *Agrobacterium* infection with PHP79023: embryos were incubated in an *Agrobacterium* suspension (OD=1.0 at 550 nm) with PHI-I medium for 5 min; (2) co-cultivation: embryos were cultured on PHI-T medium following infection for 7 d at 25° C. in the dark; (3) selection during maturation: embryos were matured on 289M with 0.1 mg/l imazapyr medium for 4 wk, followed by rooting on medium 13113A with 0.1 mg/l imazapyr (Medium 13113A contains half-strength MS salts and vitamins, 0.05 g/l myo-inositol, 20 g/l sucrose, and 3 g/l phytagel, pH5.6). Regenerated plantlets were transplanted into soil and grown in the greenhouse (Zhao et al. 2000). To plants were self-pollinated to produce $T_1$ progeny for further analysis.

B. *Agrobacterium* Strains and Vectors Used with *Sorghum*.

*Agrobacterium tumefaciens* strains LBA4404 (Lazo et al. (1991) Biotechnology 9:963-967) was used, containing a first plasmid containing *Agrobacterium* vir genes (Komari (1990) Plant Cell 9:303-306; Komari et al. (1996) Plant J 10:165-174) and a second plasmid (PHP80334) containing a T-DNA with the following components: RB+ZM-AXIG1 PRO::ZM-WUS2::IN2-1 TERM+ZM-PLTP PRO::ZM-ODP2::OS-T28 TERM+GZ-W64A TERM+UBI PRO: UBI1ZM INTRON:ESR::SB-SAG12 TERM+SB-ALS PRO:: HRA::SB-PEPC1 TERM+UBI PRO:UBI1ZM INTRON:ZS-GREEN1::PINII TERM:SB-ACTIN TERM-LB. For comparison, another *Agrobacterium* was used that contained a second plasmid with only a UBI PRO:UBI1 ZM INTRON:PMI::PINII TERM expression cassette in the T-DNA (with no ZM-WUS2 or ZM-ODP2 expression cassettes) which represents the control treatment in this experiment.

C. *Sorghum* Transformation Results.

The overall transformation frequency was 20% when the control plasmid was used, and of the T0 plants sent to the greenhouse and analyzed using qPCR, 40% were single-copy with no *Agrobacterium* backbone. For the control treatment, the duration from the start of *Agrobacterium* infection until T0 plants were sent to the greenhouse varied from 10-13 weeks.

The overall transformation frequency was 32% when the plasmid containing the Zm-PLTP PRO::ZM-ODP2+DR5 PRO::ZM-WUS2 (see PHP79023 in Table 1) was used, and of the T0 plants sent to the greenhouse and analyzed using qPCR, 42% were single-copy with no *Agrobacterium* backbone, proceeding directly to somatic embryo formation from the originally-infected zygotic immature embryos, followed by somatic embryo maturation, in vitro germination and root formation. Using this combination of promoters and developmental genes substantially reduced the time from *Agrobacterium* infection to sending T0 plants to the greenhouse by approximately half relative to the control treatment.

In an additional experiment using the PHP82240 plasmid with a T-DNA containing RB−ZM-AXIG1 PRO::ZM-WUS2::IN2-1 TERM+ZM-PLTP PRO::ZM-ODP2::OS-T28 TERM+SB-ALS PRO::ZM-HRA::PINII TERM+a constitutive DsRED expression cassette-LB, it was demonstrated that direct formation of sorghum somatic embryos was improved by use of PHP82240 with seven days of co-cultivation on 710I media with 50 mg/L carbenicillin. This combination of plasmid and the seven day co-cultivation resulted in doubling the overall transformation frequency from 17.7% to a final value of 38.9%, while reducing the time from *Agrobacterium* infection to T0 plants to the greenhouse by approximately half relative to the control treatment (reducing this timeframe to 5-6 weeks total elapsed time).

Example 12: High Efficiency Transformation and Rapid T0 Plant Production in Wheat A. Wheat Transformation Methods.

An aliquot of *Agrobacterium* strain LBA4404 containing the vector of interest was removed from storage at −80° and streaked onto solid LB medium containing a selective agent (kanamycin or spectinomycin, depending on which plasmids the bacterial strain contains). The *Agrobacterium* was cultured on the LB plate at 21° C. in the dark for 2-3 days, at which time a single colony was selected from the plate, streaked onto an 810D medium plate containing the selective agent and then incubated at 28° C. in the dark overnight. The *Agrobacterium* culture was transferred from the plate using a sterile spatula and suspended in ~5 mL wheat infection medium (WI4) with 400 uM acetosyringone (AS). The optical density (600 nm) of the suspension was adjusted to about 0.1 to 0.7 using the same medium.

Four to five spikes containing immature seeds (with 1.4-2.3 mm embryos) were collected, and the immature embryos were isolated from the immature seeds. The wheat grains were surface sterilized for 15 min in 20% (v/v) bleach (5.25% sodium hypochlorite) plus 1 drop of Tween 20, followed with 2-3 washes in sterile water. The remaining protocol wheat including infection with *Agrobacterium*, co-cultivation, culture during the resting period, somatic embryo maturation and rooting, as described in Examples 4 and 5 for were followed, including the step of selection on 0.1 mg/l imazapyr and maturation for production of transgenic T0 wheat plants.

B. Wheat Transformation Results.

*Agrobacterium tumefaciens* strain LBA4404 (Lazo et al. 1991, Biotechnology 9:963-967) was used, which contained a first super binary helper plasmid (pVIR9, U.S. Provisional Appl. No. 62/252,229, herein incorporated in entirety by reference) and a second plasmid (PHP79066), with the developmental genes containing a T-DNA with the following components; RB+ZM-AXIG1 PRO::ZM-WUS2::IN2-1 TERM+ZM-PLTP PRO::ZM-ODP2::OS-T28 TERM+SB-ALS PRO:: HRA::SB-PEPC1 TERM+LTP2 PRO::ZS-YELLOW1 N1::PINII TERM+LB. For comparison, another

*Agrobacterium* was used that contained a second plasmid (PHP24600) with the following T-DNA: RB+CAMV35S TERM: PAT: CAMVS PRO+UBIZM PRO: DS-RED: PINII TERM+LB, which represented the control treatment in this experiment.

Figure 5:
FIG. 5 shows early germinating shoots derived from rapidly-formed somatic embryos two weeks after *Agrobacterium* infection of immature embryos of Pioneer elite Spring wheat variety HC0456D.
Figure 6:
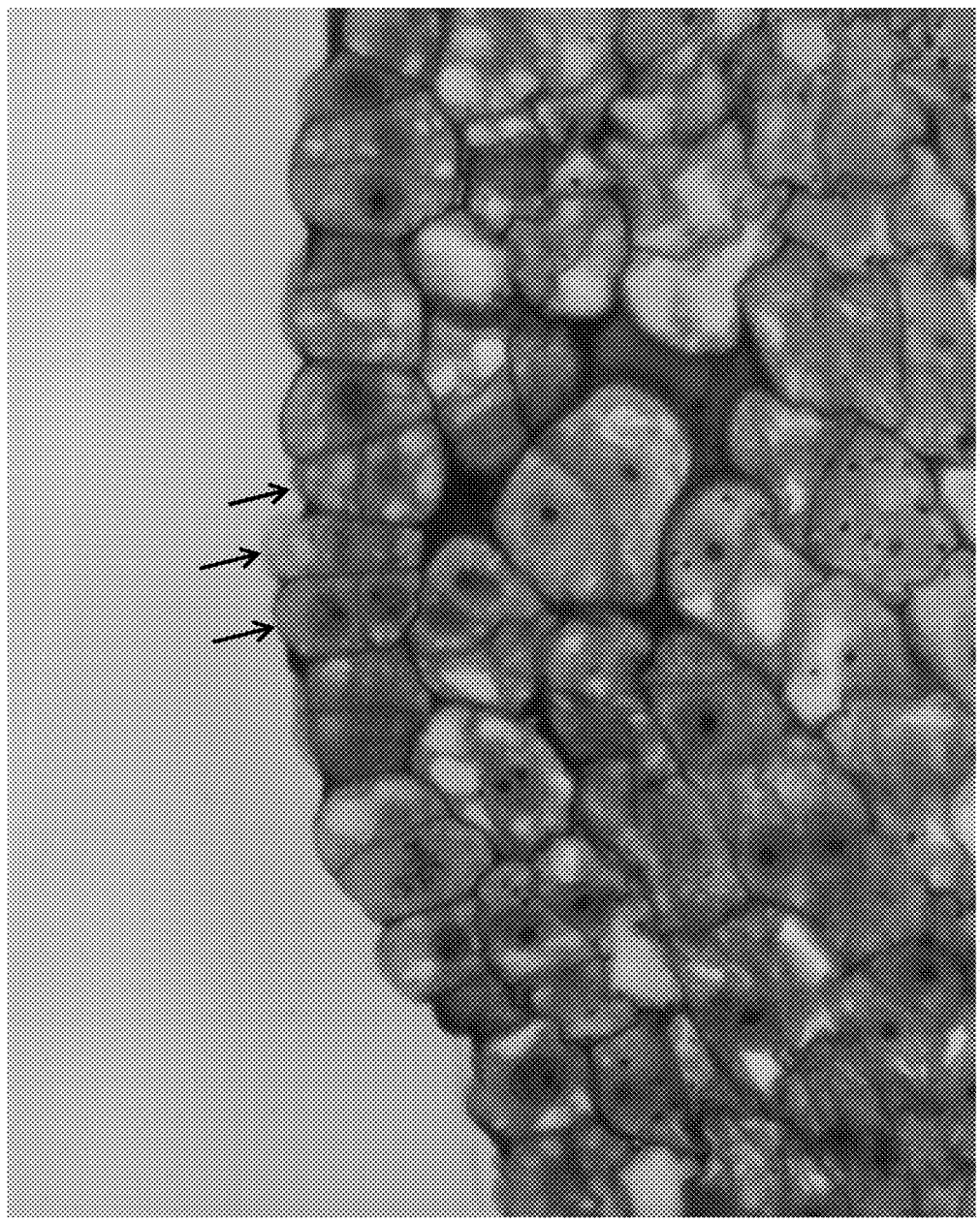
FIG. 6 shows a representative image of early anticlinal divisions on the surface of the scutellum (arrows) from an immature zygotic embryo two days after *Agrobacterium* transfection.
Figure 7:
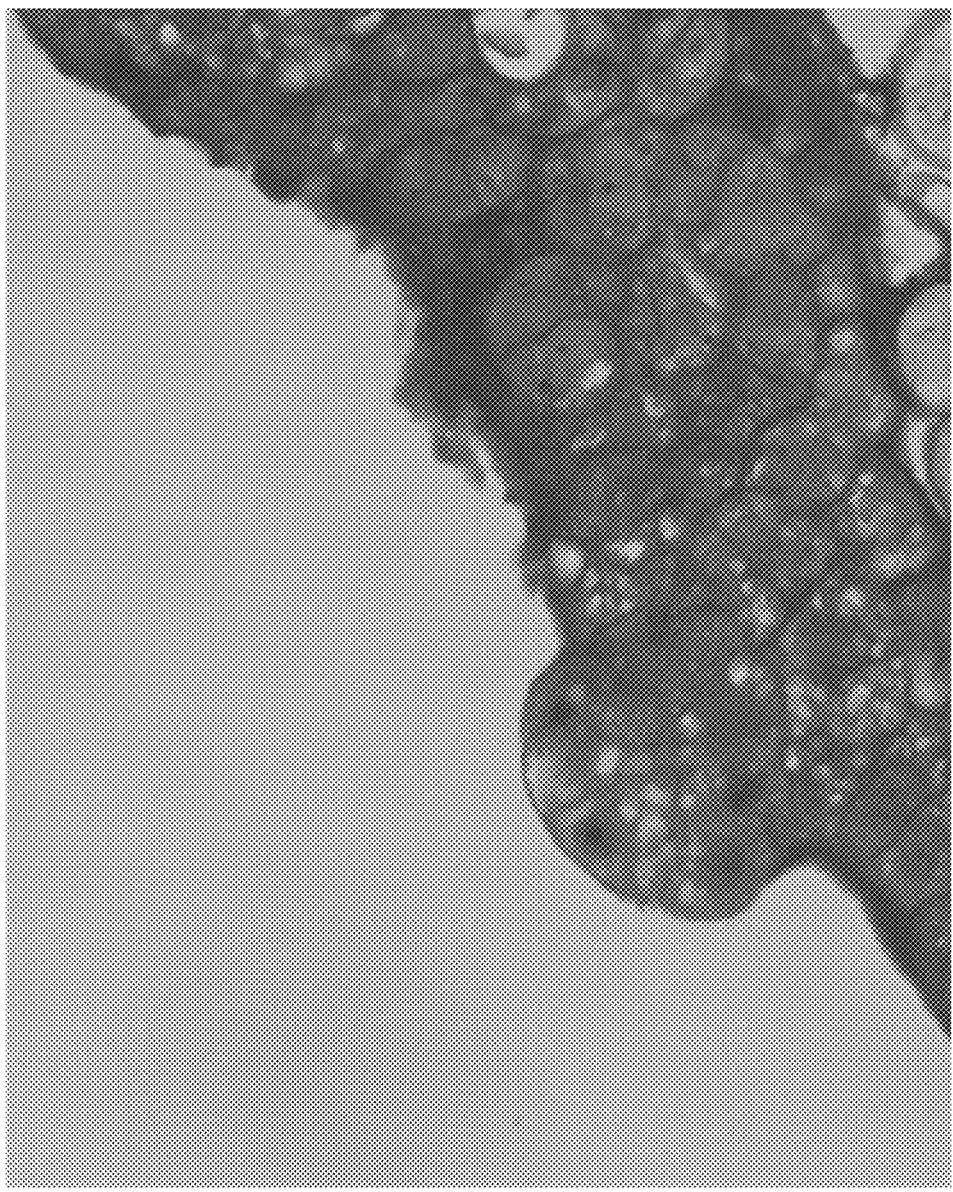
FIG. 7 shows a representative image of a small globular somatic embryo forming on the surface of the scutellum from a transfected immature zygotic embryo two days after *Agrobacterium* transfection.
Figure 8:
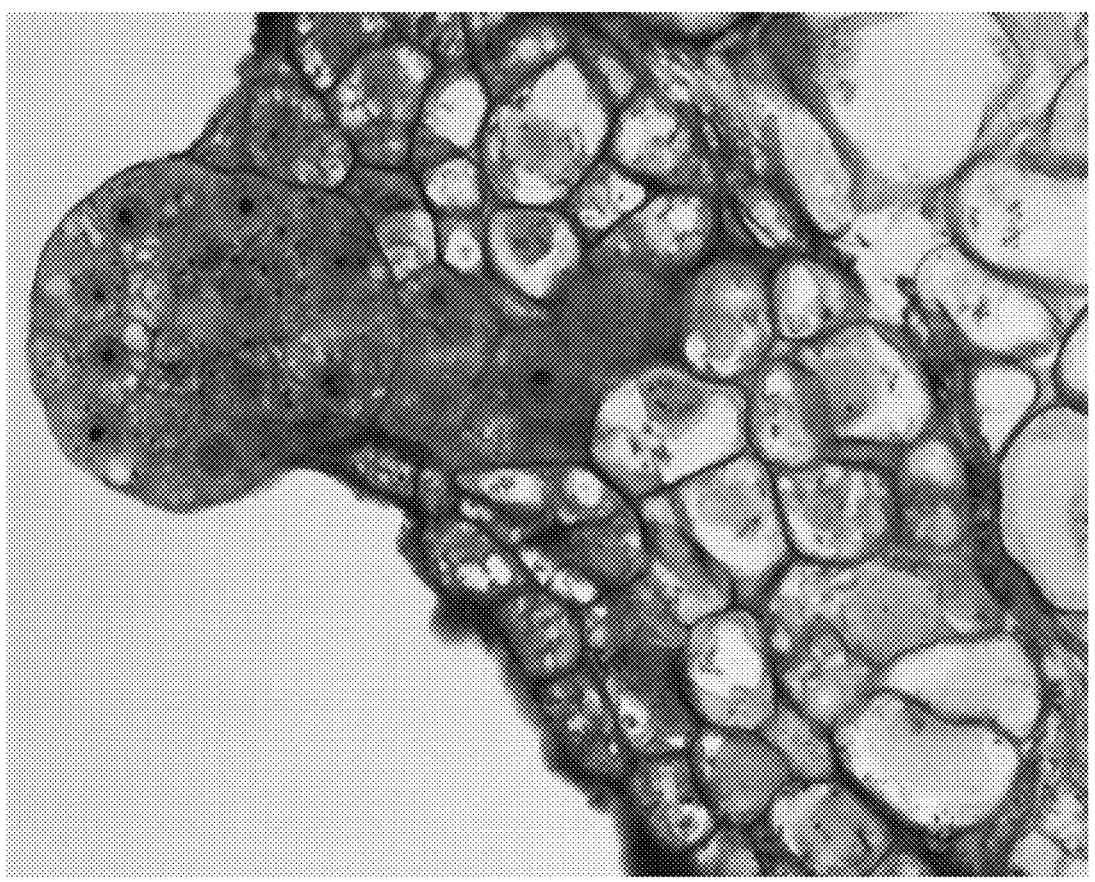
FIG. 8 shows a representative image of a larger globular somatic embryo forming on the surface of the scutellum from the transfected immature zygotic embryo two days after *Agrobacterium* transfection.
Figure 9:
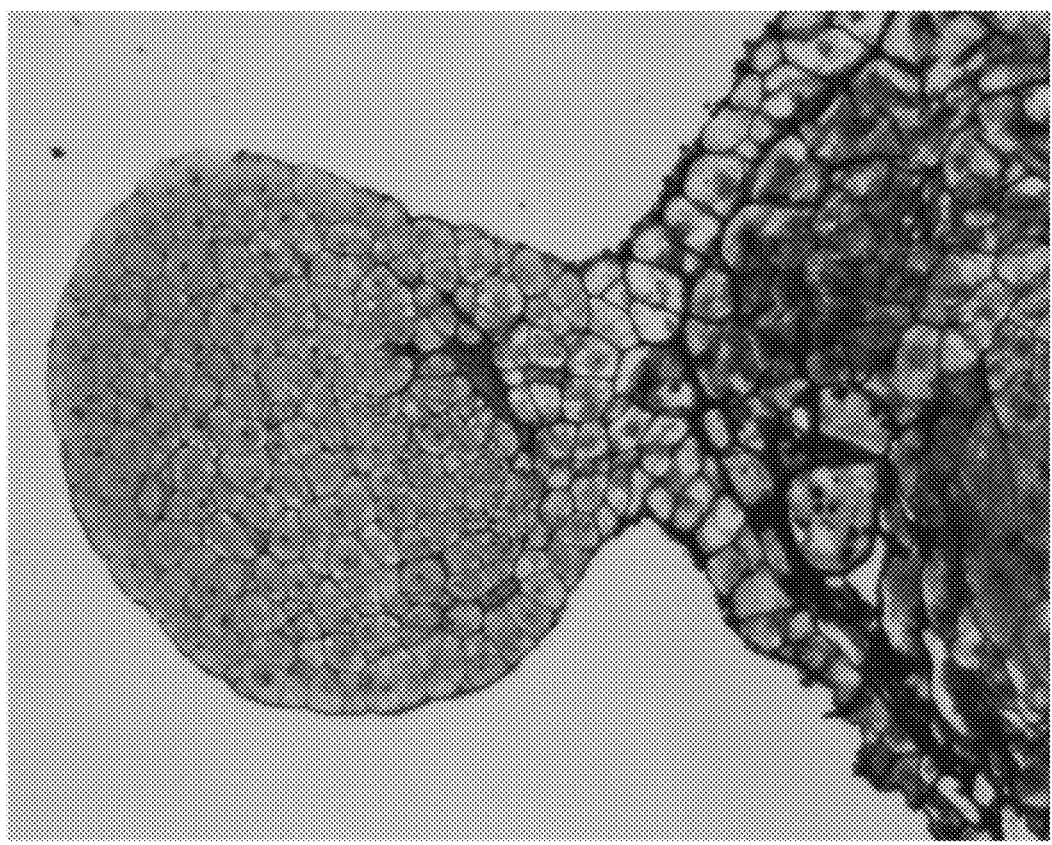
FIG. 9 shows a representative image of a transition-stage somatic embryo that formed on the surface of the scutellum from the transfected immature zygotic embryo four days after *Agrobacterium* transfection, showing the smooth surface of the somatic embryo and the lack of vascular connections with the underlying zygotic embryo.
Figure 10:
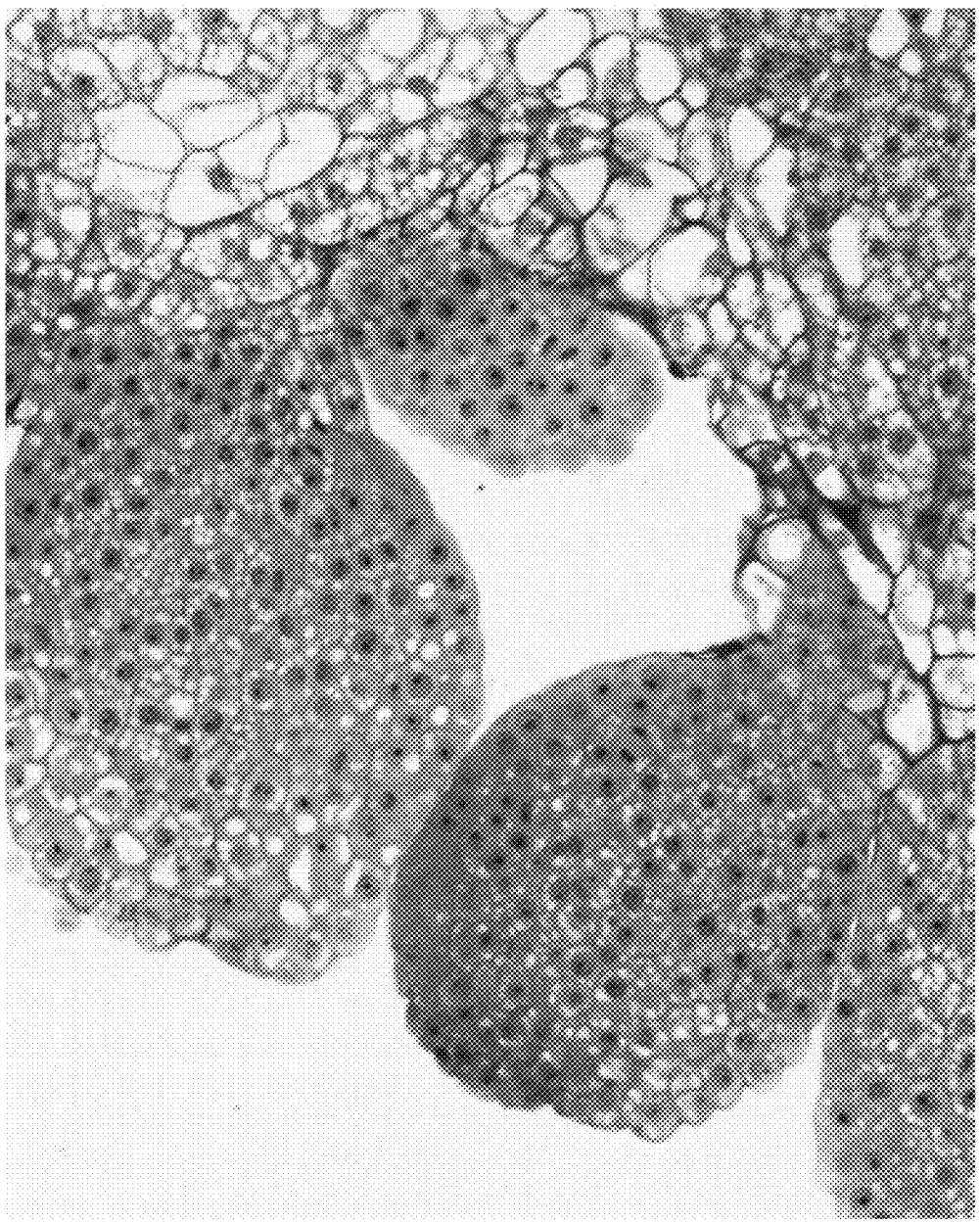
FIG. 10 shows a representative image of multiple transition-stage somatic embryos that have formed on the surface of the scutellum from the transfected immature zygotic embryo four days after *Agrobacterium* transfection, demonstrating that somatic embryos in close proximity were derived from the underlying zygotic embryo surface and not through secondary somatic embryogenesis.
Figure 11:
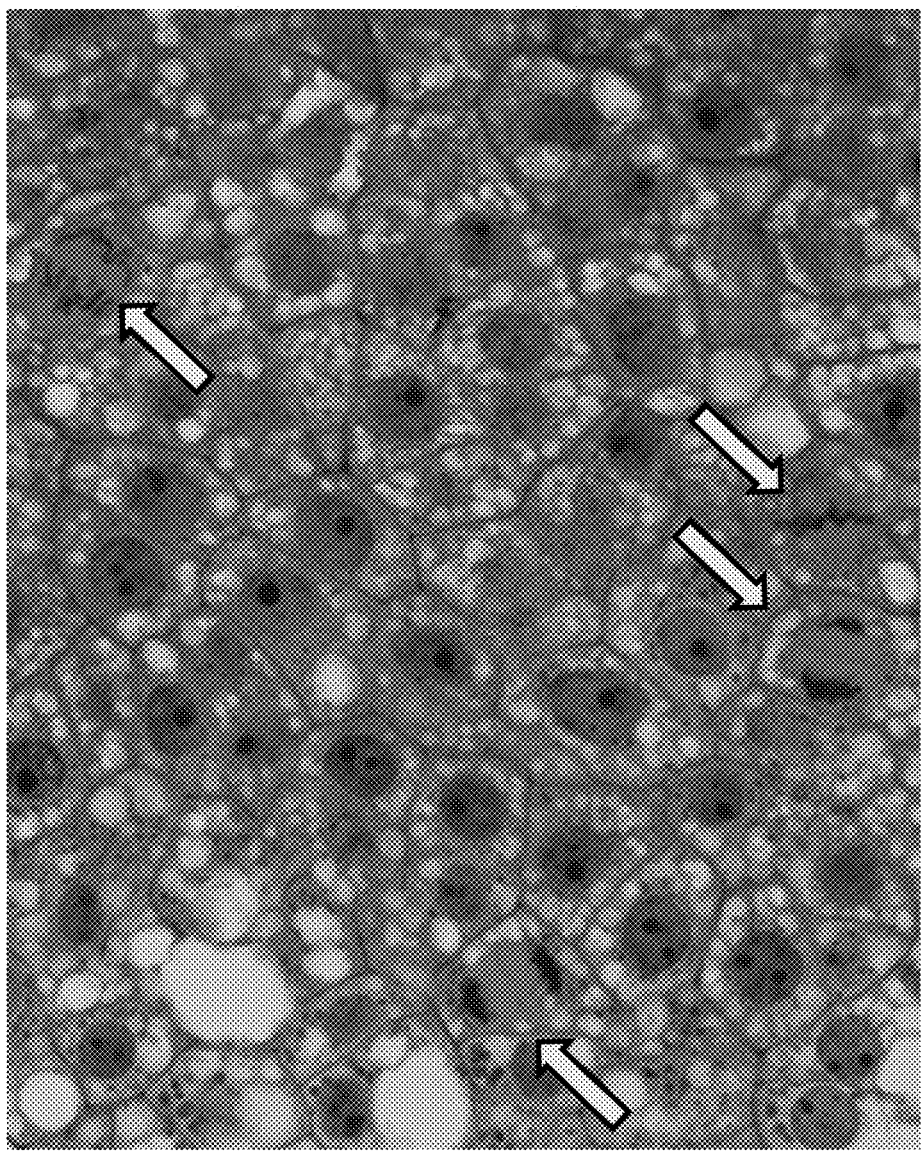
FIG. 11 shows a representative higher magnification image demonstrating the high mitotic index within the developing somatic embryos, as indicated by the metaphase and anaphase structures observed in multiple cells within the field of view (as indicated by the arrows).

When the control plasmid was used to transform wheat immature embryos from Pioneer elite Spring wheat variety HC0456D, no regenerable structures were observed in the first 7-10 days after *Agrobacterium* infection, while immature embryos that were infected with the developmental gene construct PHP79066 produced regenerable structures 7-10 days post-infection using maize culture medium described in Examples 4 and 5. The embryos infected with construct PHP79066 produced plant-like structures within 2 weeks (FIG. 5), as compared to proliferating callus observed for the control construct (not shown). Rooted plantlets were recovered after transformation with PHP79066 within 6 weeks post infection.

When the plasmid containing the ZM-AXIG1 PRO::ZM-WUS2::N2-1 TERM+ZM-PLTP PRO::ZM-ODP2::OS-T28 TERM+SB-ALS PRO:: HRA::SB-PEPC1 TERM+LTP2: ZS-YELLOW::PINII TERM was used for transformation, the overall transformation frequency was 64% (compared to 6% for the control). A subset of four plants was analyzed using qPCR, and three were positive for both WUS and the ZS-YELLOW transgene. Using this combination of developmental genes, T0 plants regenerated in 8-11 weeks post infection, reducing the time from *Agrobacterium* infection to sending T0 plants to the greenhouse by two-three weeks.

Example 13: Observations of Rapid De Novo Embryo Formation in Corn and Production of to Plants A. Morphology of Developing Somatic Embryos.

After transformation of immature embryos from the Pioneer inbred PH184C with the *Agrobacterium* strain LBA4404 harboring a T-DNA containing the expression cassettes ZM-AXIG1 PRO::ZM-WUS2::IN2-1I TERM+ ZM-PLTP PRO::ZM-ODP2::PINII+UBI PRO: UBI1ZM INTRON:ZS-GREEN::PINII TERM, somatic embryos rapidly formed on the surface of the scutellum (i.e. within 4-6 days). Directly-formed, single somatic embryos were observed at 2, 4, 7, and 12 days after the beginning of *Agrobacterium* infection. In Inbred PH184C, when the combination of NOS PRO::ZM-WUS2::PINII TERM+ZM-PLTP::ODP2::PINII TERM was used, the single somatic embryos were observed as attached to the scutellum of the originally-transformed zygotic embryo by a thin tether of cells that appeared to recapitulate the suspensor, As embryo development continued, additional morphological features were observed that are normally observed in zygotic embryos, including formation of a distinctive coleoptilar ring around the apical meristem at the inception of apical meristem development, and formation of the scutellum (which turns white and opaque) surrounding the embryo axis.

To further illustrate the morphology of the rapidly-forming somatic embryos, zygotic embryos with protruding nascent somatic embryos were sampled at 2, 4, 6, and 7 days after the beginning of *Agrobacterium* infection, and were fixed in 2.5% EM-grade glutaraldehyde in 100 mM phosphate buffer (pH 7.0) at room temperature with rotation at 100 rpm for 4 hours. After washing with 100 mM phosphate buffer (pH 7.0) three times for 15 minutes each, the samples were dehydrated in a step-wise fashion; 1-2 hours in 70% EtOH, 1-2 hours in 80% EtOH, 1-2 hours in 95% EtOH, 1-2 hours in 100% EtOH, and 2 hours in 100% EtOH. The tissue was then infiltrated with activated Technovit 7100 glycolmethacrylate following the manufacturer's recommendation, for 2 hours, and again with refreshed activated Technovit 7100 overnight. The infiltrated tissue samples were placed in molds, and the Technovit 7100 was polymerized by the addition of 1 ml Hardener II into 15 mls of activated Technovit 7100. The molds were placed under house vacuum in a vacuum desiccator and allowed to polymerize overnight. Semi-thin 2 µm sections were placed on drops of water on glass slides and dried on a heating plate at 45° C. The sections were stained with periodic acid-Schiff reagent (Sigma) according to instructions and were then counterstained with 0.5% Naphthol Blue Black in 7% acetic acid solution for 5 minutes and washed again in deionized water. The sections were then mounted in Permount with glass coverslips and observed.

FIG. 6 through FIG. 11 show a timecourse for HC69 zygotic immature embryos at various days after *Agrobacterium* infection with LBA4404 with a T-DNA which contained the following: RB–AXIG1 PRO::ZM-WUS2::IN2-1 TERM+ZM-PLTP PRO::ODP2::PINII TERM-LB. One of the earliest indications of localized growth stimulation was the observation of anticlinal divisions in cells on the surface of the infected scutellum (FIG. 6), which was the first visible disruption in this surface layer that normally expands via periclinal divisions that accompany embryo growth. Continued localized cell divisions resulted in small clusters of cells that began to protrude from the zygotic embryo surface (FIG. 6), and this growth rapidly produced increasingly large globular (FIG. 8) and globular/transition-stage (FIG. 8) embryos, which after only 4 days post-infection contained up to 700-800 cells per somatic embryo, and exhibited the typical smooth epidermal layer normally observed in proembryos, and with no vascular connections with the underlying zygotic embryo. Even though the developing somatic embryos were observed in close proximity (FIG. 10) they represented independently-derived structures. Throughout the growth of the somatic embryos in the first 6-7 days post-*Agrobacterium*-infection, a high frequency of mitotic structures (i.e. cells clearly undergoing prophase, metaphase, anaphase or cytokinesis) were observed (FIG. 11) which was indicative of the extremely rapid growth rate of these somatic embryos.

B. Staining to Demonstrate Lipid Accumulation in the Developing Somatic Embryos.

Figure 12:
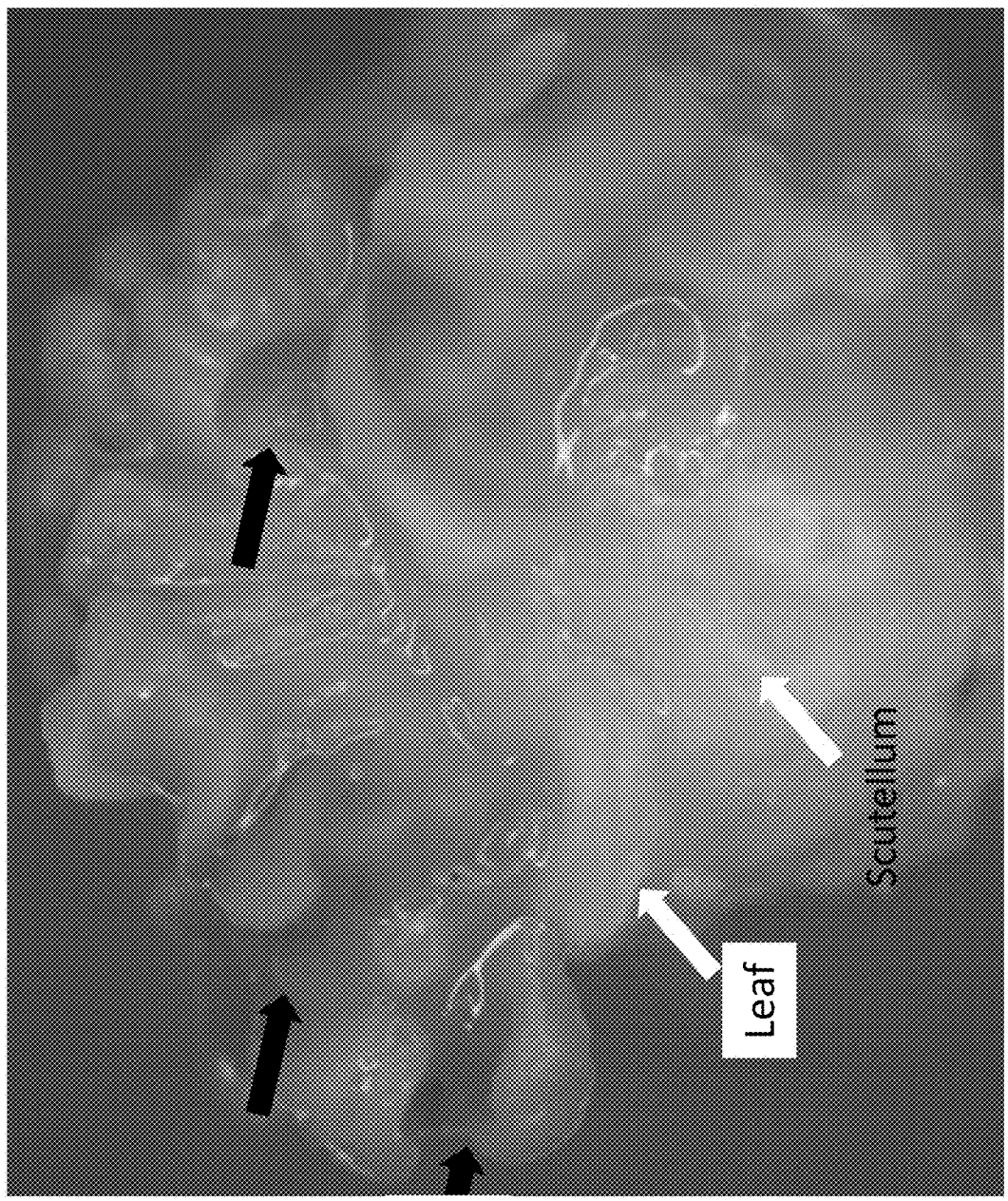
FIG. 12 shows a maize immature embryo 10 days after being transformed with a T-DNA containing AXIG1 PRO:: WUS2 with PLTP PRO::BBM. Numerous somatic embryos, some of which have fused together as they developed, and an early developing leaf are observed growing from the scutellum surface. After staining for 20 minutes with Oil Red O, and washing twice in 70% isopropanol, the lipids that accumulated during somatic embryo development stained red (black arrows), while the developing leaf (labeled with a white arrow) and the originally-transformed zygotic scutellum (labeled with a white arrow) accumulated very little stain indicating the typical lower level of lipid deposition in these tissues.

Directly-formed somatic embryos developing on the scutellur surface of immature zygotic embryos after *Agrobacterium*-mediated transformation (with a T-DNA containing AXIG1 PRO::ZM-WUS2::IN2-1 TERM+ZM-PLTP PRO::ODP2::PINII TERM) were sampled at 2, 4 and 7 days after *Agrobacterium* infection, washed for 5 minutes in 70% isopropanol, and then stained for 20 minutes in a 0.5% solution of "oil Red O" in 70% isopropanol, washed for 2 minutes in isopropanol and then washed twice in water for 5 minutes each (all at room temperature). At two days after *Agrobacterium* infection, very little lipid staining, as evidenced by red color forming in the tissue, was present in the zygotic immature embryos. At four days after starting the *Agrobacterium* infection, numerous globular structures (newly-formed somatic embryos) were clearly visible growing from the surface of the originally-transformed zygotic embryo, and these new somatic embryos clearly stained red indicating the accumulation of lipids. At seven days, a mixture of structures was observed; some that were clearly somatic embryos that were continuing to develop and stained red (black arrows in FIG. 12), and some somatic embryos that were beginning to differentiate meristems and leaves which were already beginning to lose the red staining associated with lipid accumulation (FIG. 12). Also seen in FIG. 12, the scutellum of the original *Agrobacterium*-infected zygotic embryo was almost devoid of lipid under these culture conditions.

Figure 13:
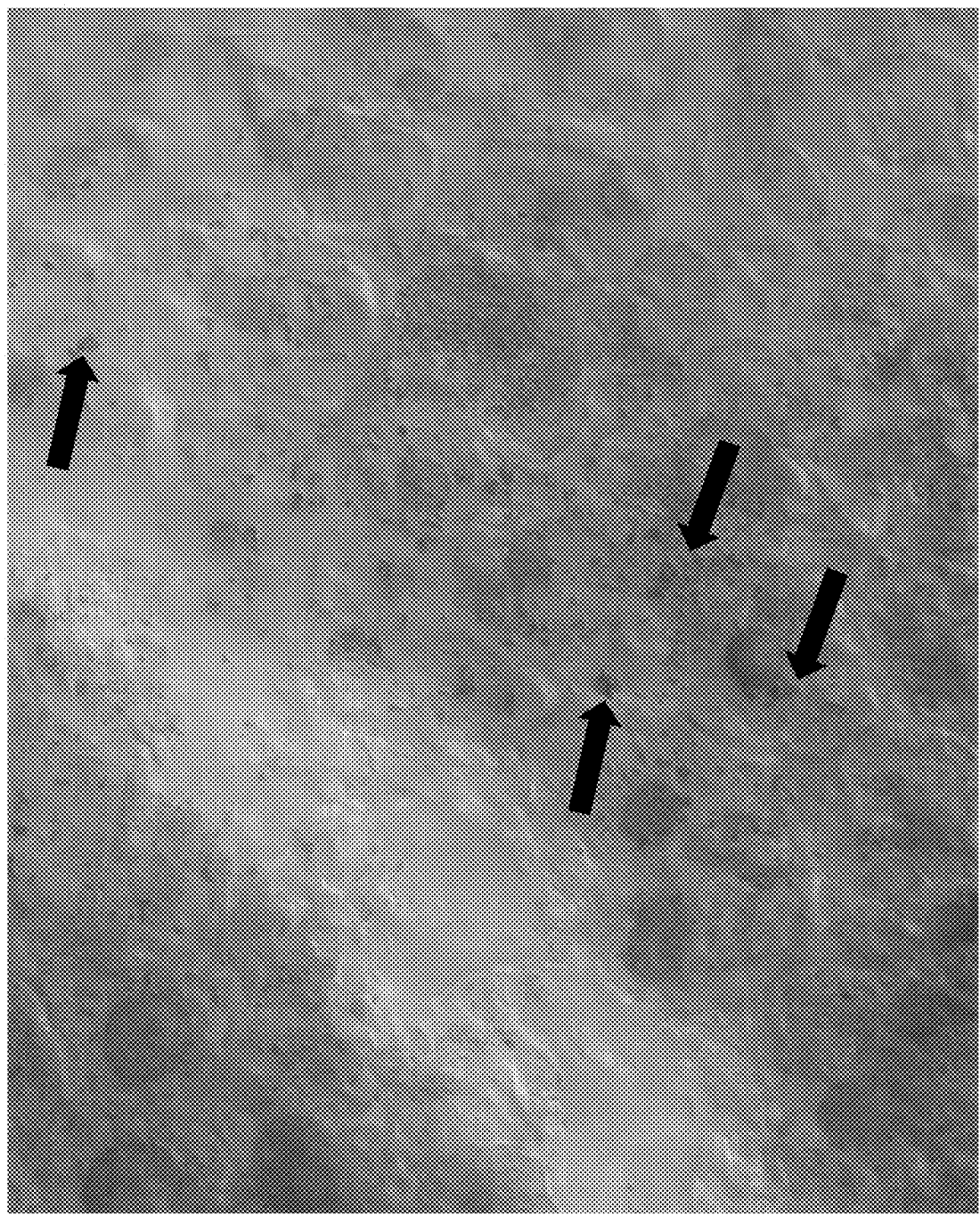
FIG. 13 shows a light micrograph of somatic embryo cells after the embryo was pressed between a cover slip and slide and then stained with Oil Red O. Red-staining lipid droplets (as exemplified by the black arrows) were clearly observed scattered within the cells.

Alternatively, lipid was visualized by placing a somatic embryo between a cover slip and a slide and applying pressure until a monolayer of cells was extruded. After using the Oil Red O staining method described above, numerous oil droplets were observed scattered within the somatic embryo cells when viewed under the light microscope (FIG. 13).

Lipid can be detected using similar staining protocols in sectioned somatic embryos. Directly-formed, single somatic embryos are sampled at 2, 4, 8, and 12 days after the beginning of *Agrobacterium* infection, and are fixed, dehydrated, infiltrated with plastic and sectioned as described above. For staining for lipids, a 0.5% "Oil Red O" solution in 60% triethyl phosphate (aqueous) is prepared and filtered. The tissue sections on the slide are rinse briefly with 60% triethyl phosphate, and then stained for 10-20 minutes in "Oil Red O". After staining, the sections are rinsed again with triethyl phosphate for 1-2 seconds and then washed with distilled, deionized water. The sections are then counter-stained with 0.5% Celestine Blue in 5% aqueous ferric ammonium sulfate for 15 minutes and washed again in DI water. The sections are then mounted using aqueous mounting medium and observed. In the developing somatic embryos, the accumulating lipids in the scutellum appear red, and over the entire section (including the scutellum and embryo axis) the nuclei in each cell will stain blue.

Example 14: Transformation Using WUS2 Alone, ODP2 Alone, or WUS/ODP2 in Combination Immature embryos were harvested from three Pioneer inbreds (PH184C, HC69 and PHH5G) and the embryos from each inbred were evenly aliquoted for transformation with *Agrobacterium* strain LBA4404 containing one the following PHP79066 (SEQ ID NO: 27), PHP80912 (SEQ ID NO: 53), and PHP80913 (SEQ ID NO: 54; each are described in detail in Table 1).

After *Agrobacterium*-mediated transformation, the three different inbreds responded differently to the different transgene combinations (Table 12). For inbred PH184C, 230 immature embryos were infected for each treatment, with 84, 10, and 100% of the originally-infected zygotic embryos producing somatic embryos on the scutellar surface when expressing either AXIG1::WUS2 alone, PLTP::ODP2 alone, or the combination of both WUS2 and ODP2, respectively. After 7 days, all the embryos were moved to maturation and then germination media, with 68, 8 and 52 embryos producing T0 plants for the three respective treatments (T0 transformation efficiencies of 30%, 3% and 23%, respectively). For inbred HC69, 80 immature embryos were used for each treatment, with somatic embryos and T0 plants being efficiently produced in all three treatments, producing final transgenic T0 plant frequencies (relative to the number of starting embryos) of 85%, 56% and 68% for the AXIG1::WUS2, PLTP::ODP2, or the combined WUS2+ODP2 treatments, respectively. Finally, for the inbred PHH5G, 168 immature embryos were infected for each of the three treatments, with final transgenic T0 plant frequencies (relative to the number of starting embryos) of 27%, 0% or 48% for the AXIG1::WUS2, PLTP::ODP2, or the combined WUS2+ODP2 treatments, respectively. These data demonstrated that although the inbreds exhibited different responses to the WUS alone, ODP2 alone, or the combination, expression of the individual transcription factors were effective in producing transgenic somatic embryos and T0 plants.

TABLE 12

Transformation response in three inbred after delivery of WUS2 alone, ODP2 alone, or the combination of WUS2 with ODP2

| Inbred | Embryos (#) | Plasmid No. | DevGene | Embryos producing Somatic Embryos (%) | Embryos (# regen.) | Embryos (# producing a plant; one plant per embryo) | Trans. Efficiency (T0 level) |
|---|---|---|---|---|---|---|---|
| PH184C | 230 | PHP80913 | Axigi:op:WUS2 | 84% | 230 | 68 | 30% |
| PH184C | 230 | PHP80912 | PLTP:ODP2 | 10% | 230 | 8 | 3% |
| PH184C | 230 | PHP79066 | Axig1:op:WUS2 + PLTP:ODP2 | 100% | 230 | 52 | 23% |
| HC69 | 80 | PHP80913 | Axigi:op:WUS2 | 69% | 80 | 68 | 85% |
| HC69 | 80 | PHP80912 | PLTP:ODP2 | 65% | 80 | 45 | 56% |
| HC69 | 80 | PHP79066 | Axig1:op:WUS2 + PLTP:ODP2 | 100% | 80 | 54 | 68% |
| PHH5G | 168 | PHP80913 | Axigi:op:WUS | 57% | 168 | 46 | 27% |
| PHH5G | 168 | PHP80912 | PLTP:ODP2 | 0% | 168 | 0 | 0% |
| PHH5G | 160 | PHP79066 | Axig1:op:WUS2 + PLTP:ODP2 | 91% | 160 | 77 | 48% |

Example 15: Improved Transfer of Plantlets Produced from Single Somatic Embryos to the Greenhouse Immature embryos (9-11 DAP) of three genotypes (HC69, PHH5G, and PH184C) were infected with PHP79066. Embryos were transferred to co-cultivation media (710I) for 1-3 days, resting media 605G (605J media+2 mg/l meropenem) for 7 days, and then onto maturation media 13329 (289O+0.1 mg/l imazapyr). After 3-4 weeks on maturation media, strong single shoots were transferred to EXcel Plugs (40/80) (International Horticulture Technologies, LLC, 2410 Airline Hwy, Hollister, Calif., 95023) and sprayed with Moisturin (WellPlant, Inc., 940 Spice Islands Drive, Sparks, Nev., 89431). The shoots were cultured under Valoya (Valoya Oy, Lauttasaarentie 54A, 00200 Helsinki, Finland) R-series NS2 LED lights (220-305 µmol/m$^2$/sec) at 27° C. for 2-3 weeks. Plugs were watered with 6N salts and vitamins plus 0.1 mg/L imazapyr every 2-3 days as needed. After the establishment of roots, the plugs were transferred to the T0 receiving greenhouse and grown for an additional two weeks. At the conclusion of this time frame, survival data were collected for each of the genotypes and is given below in Table 13.

TABLE 13

Improved survival of T0 plants transferred to the greenhouse.

| Genotype | Shoots* | Plantlets** |
|---|---|---|
| PH184C | 54 | 37 (68.5%) |
| PHH5G | 36 | 17 (47.2%) |
| HC69 | 36 | 27 (75.0%) |

*Total number of shoots transferred to Excel plugs.
**Number of plantlets that survived at the conclusion of the experiment, with percentage survival given in parentheses.

Example 16: Results on Use of *Sorghum* PLTP Promoter to Directly Produce Somatic Embryos in Corn The *Sorghum bicolor* PLTP promoter (SB-PLTP PRO) is provided as SEQ ID NO:2. Immature embryos from Pioneer inbred PH184C or PHH5G were transformed with the *Agrobacterium* strain LBA4404 harboring the plasmid RV012608 containing a T-DNA (SEQ ID NO:95), RB+ZM-AXIG1 PRO::ZM-WUS2::IN2-1 TERM+SB-PLTP1 PRO:: ZM-ODP2:: OS-T28 TERM+GZ-W64A TERM+UBI PRO: UBI1ZM INTRON:ESR::SB-SAG12 TERM+SB-ALS PRO:: HRA::SB-PEPC1 TERM+UBI PRO::ZS-GREEN1:: PINII TERM:SB-ACTIN TERM-LB. Many discreet somatic embryos formed on the surface of the inbred zygotic embryos after 4-6 days in culture. These early somatic embryos were clearly distinct from one another (i.e. with intervening non-transgenic tissue between the forming somatic embryos) and were confirmed to be transgenic based on expression of the green fluorescence protein. When these embryos were transferred to maturation medium with 0.1 mg/l imazapyr, the embryos continued to develop, and when transferred to germination medium, both shoot and root elongation occurred.

Example 17: Results Using Maize ODP2 Homologs, WUS2 Homologs, and PLTP Promoters from Homologous Gene-Sources to Produce Somatic Embryos in Corn A list of WUS/WOX paralogs (family member genes and encoded proteins) and ODP2/BBM family members and their corresponding SEQ ID Numbers are shown in Table 14 below.

TABLE 14

WUS/WOX and ODP2/BBM Sequences

| SEQ ID NO. | Type* | Name | Description |
|---|---|---|---|
| 3 | DNA | ZM-WUS1 | *Z. mays* WUS1 coding sequence |
| 4 | PRT* | ZM-WUS1 | *Z. mays* WUS1 protein sequence |
| 5 | DNA | ZM-WUS2 | *Z. mays* WUS2 coding sequence |
| 6 | PRT | ZM-WUS2 | *Z. mays* WUS2 protein sequence |
| 7 | DNA | ZM-WUS3 | *Z. mays* WUS3 coding sequence |
| 8 | PRT | ZM-WUS3 | *Z. mays* WUS3 protein sequence |
| 9 | DNA | ZM-WOX2A | *Z. mays* WOX2A coding sequence |
| 10 | PRT | ZM-WOX2A | *Z. mays* WOX2A protein sequence |
| 11 | DNA | ZM-WOX4 | *Z. mays* WOX4 coding sequence |
| 12 | PRT | ZM-WOX4 | *Z. mays* WOX4 protein sequence |
| 13 | DNA | ZM-WOX5A | *Z. mays* WOX5A coding sequence |
| 14 | PRT | ZM-WOX5A | *Z. mays* WOX5A protein sequence |
| 15 | DNA | ZM-WOX9 | *Z. mays* WOX9 coding sequence |
| 16 | PRT | ZM-WOX9 | *Z. mays* WOX9 protein sequence |
| 17 | DNA | ZM-ODP2 | *Z. mays* ODP2 coding sequence |
| 18 | PRT | ZM-ODP2 | *Z. mays* ODP2 protein sequence |
| 19 | DNA | ZM-BBM2 | *Z. mays* BBM2 coding sequence |
| 20 | PRT | ZM-BBM2 | *Z. mays* BBM2 protein sequence |
| 21 | DNA | ZM-ODP2 | *Z. mays* ODP2 coding sequence (synthetic) |

*"DNA" indicates a polynucleotide or nucleic acid sequence; "PRT" indicates a polypeptide or protein sequence.

For these studies described in sections A, B and C below, a single T-DNA configuration was utilized (SEQ ID NO:104), starting with the following positive control: RB+ZM-AXIG1 PRO::ZM-WUS2::IN2-1 TERM+ZM-PLTP PRO::ZM-ODP2:: OS-T28 TERM+GZ-W64A TERM+UBI PRO:UBI1ZM INTRON:ESR::SB-SAG12 TERM+SB-ALS PRO:: HRA::SB-PEPC1 TERM+UBI PRO::ZS-GREEN1::PINII TERM:SB-ACTIN TERM-LB. Within the context of this T-DNA, all the components of the T-DNA remained the same except for three variables described below. In the first variable, ZM-WUS2 (in the control plasmid) was replaced by either ZM-WOX2A, ZM-WOX4, ZM-WOX5A, or the sorghum (SB) WUS1. In the second variable, ZM-PLTP PRO (from the control treatment) was replaced by promoters from two maize paralogs (ZM-PLTP1 and ZM-PLTP2) or from three Poaceae orthologs (*Sorghum bicolor* SB-PLTP1, *Setaria italica* SI-PLTP1 or *Oryza sativa* OS-PLTP1). When the control T-DNA (all maize components as shown above) was introduced into the scutellum of Pioneer inbreds PH1V5T, PH1V69 and PHH5G, approximately half of the scutellar surface area was covered by newly developed somatic embryos after 7 days. This response was scored as a "2". At the upper end of the response spectrum the scutellum was completely covered by a lawn of individual, developing somatic embryos 4-7 days post-infection. This response was given a relative score of "4" and all other treatments were ranked from "0" (no response) to "4" (the most prolific production of somatic embryos). When no WUS2 or ODP2 expression cassettes were introduced, for example in PHP24600, SEQ ID NO:69), PH1V5T produced a low level of somatic embryos (score of 1), while both PH1V69 and PHH5G produced no response (score of 0).

A. Substitution of ZM-WOX Family Members or a *Sorghum* WUS1 for ZM-WUS2 Produced Varying Degrees of Rapidly Formed Somatic Embryos.

In this experiment, a positive control plasmid, containing the ZM-AXIG1 PRO::ZM-WUS2+ZM-PLTP PRO::ZM-ODP2 in the T-DNA (SEQ ID NO; 104) produced an intermediate (score of 2) response in inbreds PH1V5T and PHH5G, while producing a lower score of "1" in inbred PH1V69. By comparison, when three maize WOX family members were substituted for ZM-WUS2, a range of somatic embryogenesis responses was observed (Table 15), ranging from a higher somatic embryo response from ZM-WOX2A, a low-to-no response for ZM-WOX4 and a low response for WOX5 (T-DNA sequences provided in SEQ ID NO:100, SEQ ID NO:101 and SEQ ID NO:102, respectively). Even though WOX5 and WOX4 resulted in fewer somatic embryos on the surface of the transformed immature embryo, there was still a positive response for all three inbreds with WOX5 and a subset of inbreds for WOX4. For treatments that produced a low level response, the inbred PH1V5T was difficult to interpret because it exhibited low levels of growth in the absence of WUS2 and ODP2 expression cassettes. However, for such treatments the other two inbreds became much more informative because they exhibited no background growth and a low level response (1) was unequivocal.

TABLE 15

Inbred transformation response to different WUS homologs

| ZM-AXIG1 with | ZM-PLTP constant for | Response in Inbreds | | |
|---|---|---|---|---|
| WUS/WOX | ZM-ODP2 | PH1V5T | PH1V69 | PHH5G |
| ZM-WUS2 | PLTP::ODP2 | 2 | 1 | 2 |
| ZM-WOX2a | PLTP::ODP2 | 3 | 3 | 2 |
| ZM-WOX4 | PLTP::ODP2 | 1 | 1 | 0 |
| ZM-WOX5 | PLTP::ODP2 | 2 | 1 | 1 |
| SB-WUS1 | PLTP::ODP2 | 4 | 4 | 4 |

ZM-WUS1 and ZM-WUS3 were also compared to ZM-WUS2 for stimulation of rapid growth responses after transformation. In this experiment, a plasmid containing UM::GFP::PINII TERM was co-bombarded using a standard particle bombardment protocol for maize (see Svitachev et al., 2015, Plant Physiology 169:931-945) in equimolar ratios along with a plasmid containing either UBI PRO::WUS1::PINII TERM, UBI PRO::WUS2::PINII TERM or UBI PRO::WUS3::PINII TERM. Embryos were observed under a Leica Mzfl III epifluorescence microscope with a GFP filter. After 7 days, the surface of the scutellum that was bombarded was covered with rapidly growing multicellular structures with GFP fluorescence at the center. For all three WUS3 paralogs, the growth rate was fast, the response was extensive across the surface of the bombarded scutellum, and no differences could be discerned between the three WUS paralogs. Based on these observation, one would expect that ZM-WUS1 and ZM-WUS3 would produce a similar degree of rapid somatic embryogenesis as ZM-WUS2 when placed behind the AXIG1 promoter and combined in a T-DNA with ZM-PLTP PRO::ZM-ODP2 for transformation into maize immature embryos.

A final treatment in this experiment was to substitute the sorghum (SB) WUS1 (T-DNA sequence provided as SEQ ID NO:103) for the maize WUS2. This treatment produced the most rapid and prolific somatic embryo response of any treatment, with approximately 80% of the infected embryos being entirely covered with somatic embryos.

B. Substitution of PLTP Promoters from Maize Paralogs or Three Different Poaceae Orthologs Resulted in Varying Degrees of Rapid Somatic Embryogenesis.

Using various "homologous" promoters produced a range of rapid somatic embryogenesis in three different Pioneer inbreds (Table 16) relative to the control treatment (ZM-PLTP PRO), in which the control produced scores between 1 and 2.

TABLE 16

Inbred transformation response to different PLTP promoter homologs

| ZM-AXIG1 constant for | Promoter for | Response in Inbred | | |
|---|---|---|---|---|
| ZM-WUS2 | ZM-ODP2 | PH1V5T | PH1V69 | PHH5G |
| Zm-Axig1 | ZM-PLTP | 2 | 1 | 2 |
| Zm-Axig1 | ZM-PLTP1 | 3 | 4 | 4 |
| Zm-Axig1 | ZM-PLTP2 | 3 | 3 | 3 |
| Zm-Axig1 | SB-PLTP1 | 2 | 2 | 1 |
| Zm-Axig1 | SI-PLTP1 | 1 | 1 | 2 |
| Zm-Axig1 | OS-PLTP1 | 1 | 2 | 2 |

In this experiment, the ZM-PLTP1 promoter produced the highest somatic embryogenesis scores at seven days post-infection, which ranged from 3 (roughly 75% covered with somatic embryos in PH1V5T) to 4 (totally covered as in PH1V69 and PHH5G). ZM-PLTP2 also produced results better than the control, with a uniform score of 3 across all three inbreds. For PLTP1 promoters from other members of the Poaceae, the sorghum and rice promoters produced an intermediate level response (2) in two inbreds and a low response (1) in one inbred, while the *Setaria* promoter resulted in a low level response in two inbreds and an intermediate level response in one inbred. All PLTP promoters tested resulted in positive stimulation of somatic embryogenesis after seven days.

C. ZM PLTP PRO::ZM-LEC1 in Combination with Either AXIG1::WUS2 or PLTP::ODP2 Resulted in Rapid Production of Somatic Embryos.

In previous experiments it was demonstrated that UBI PRO::ZM-LEC1 stimulated transformation frequencies in the transformable maize hybrid Hi-II (see Lowe et al., 2007, U.S. Pat. No. 7,268,271).

In this experiment ZM-PLTP::ZM-LEC1 was substituted for either AXIG1::WUS2 or PLTP::ODP2 in a control vector to assess the impact on rapid somatic embryogenesis in three inbreds. Conditions for *Agrobacterium* infection, tissue culture and scoring for embryogenesis at seven days were the same as those described in earlier examples. While both of the new combinations produced higher scores than the control, as can be seen in Table 17, AXIG1::WUS2+PLTP::LEC1 resulted in the strongest somatic embryo response across all three inbreds. Thus, PLTP::LEC1 in combination with either WUS2 or ODP2 expression cassettes was effective at stimulating rapid formation of somatic embryos.

TABLE 17

Inbred transformation response to different combinations with LEC1

| Combinations with LEC1 | Response for Inbreds | | |
|---|---|---|---|
|  | PH1V5T | PH1V69 | PHH5G |
| PLTP::LEC1 + PLTP::ODP2 | 1 | 3 | 2 |
| AXIG1::WUS2 + PLTP::LEC1 | 3 | 3 | 2 |
| AXIG1::WUS2 + PLTP::ODP2 | 2 | 1 | 2 |

D. Use of Rice WUS and ODP2 in Combination or *Setaria* WUS and ODP2 in Combination Resulted in Somatic Embryo Formation after Transformation of Maize Immature Embryos.

Starting with a maize construct containing NOS PRO::ZM-WUS2::IN2+UBI PRO::ZM-ODP2::PINII+UBI PRO::ZS-GREEN::PINII, orthologs for WUS2 and ODP2 identified in *Oryza sativa* and *Setaria italica* were synthesized and substituted for the maize genes in the above construct. Immature embryos from inbred PHH5G and PH184C were transformed using *Agrobacterium* strain LBA4404 containing either PHP80911 (maize WUS2 and ODP2), PHP79530 (rice genes) or PHP79531 (foxtail millet genes). After 14 days on culture medium, the immature embryos were examined under the dissecting microscope and the epifluorescence stereo-microscope and scored using the somatic embryogenesis scale (0-4), previously described. For inbred PH184C, the somatic embryo scores 14 days after *Agrobacterium* infection were 2, 2 and 1 (for the maize, millet and rice gene-pairs, respectively). For inbred PHH5G, the somatic embryo scores 14 days after *Agrobacterium* infection were 3, 3 and 2 (for the maize, millet and rice gene-pairs, respectively). These immature embryos were exposed to expression of WUS2 and ODP2 for twice the length of time as was the material in sections 5A, 5B and 5C above, which resulted in a higher somatic embryogenesis score than if the data had been collected at 7 days. The combinations of the cognate WUS and ODP2 genes from each species stimulated somatic embryo formation. In the absence of either WUS2 or ODP2, no somatic embryo formation was observed in PHH5G.

Within the Poaceae, maize and rice are at opposite ends of the phylogeny with millet in the middle. Based on the results with the above described divergent sequences for WUS, ODP2 and PLTP, this work demonstrated that combinations from members across the grasses can effectively be used to rapidly stimulate somatic embryogenesis after transformation.

Figure 14:
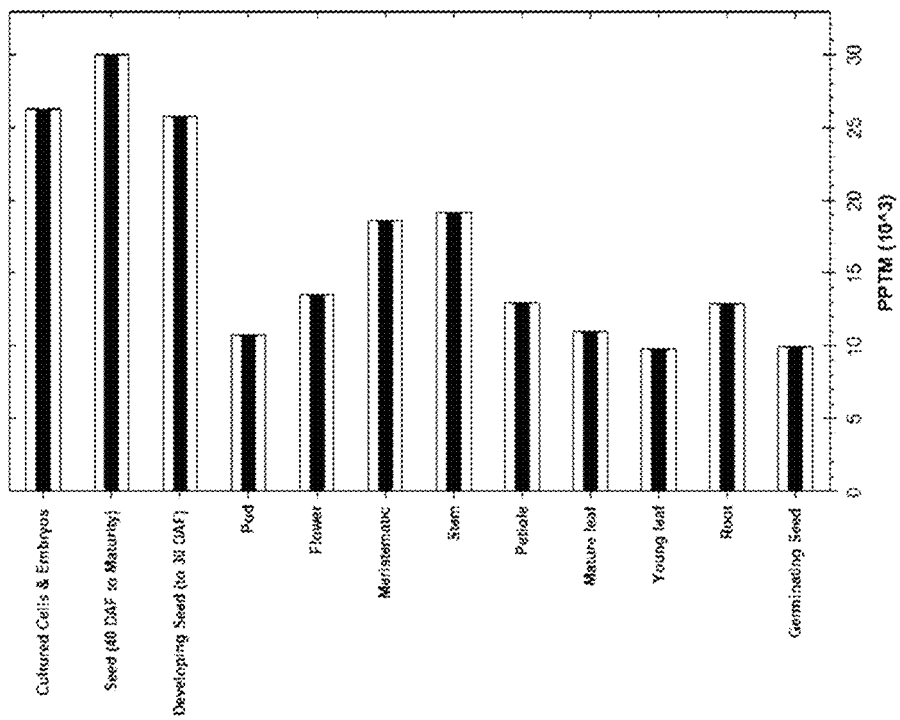
FIG. 14 shows Illumina transcript quantitation for a representative constitutively-expressed soy EF1A gene being expressed across all the plant tissues sampled.
Figure 15:
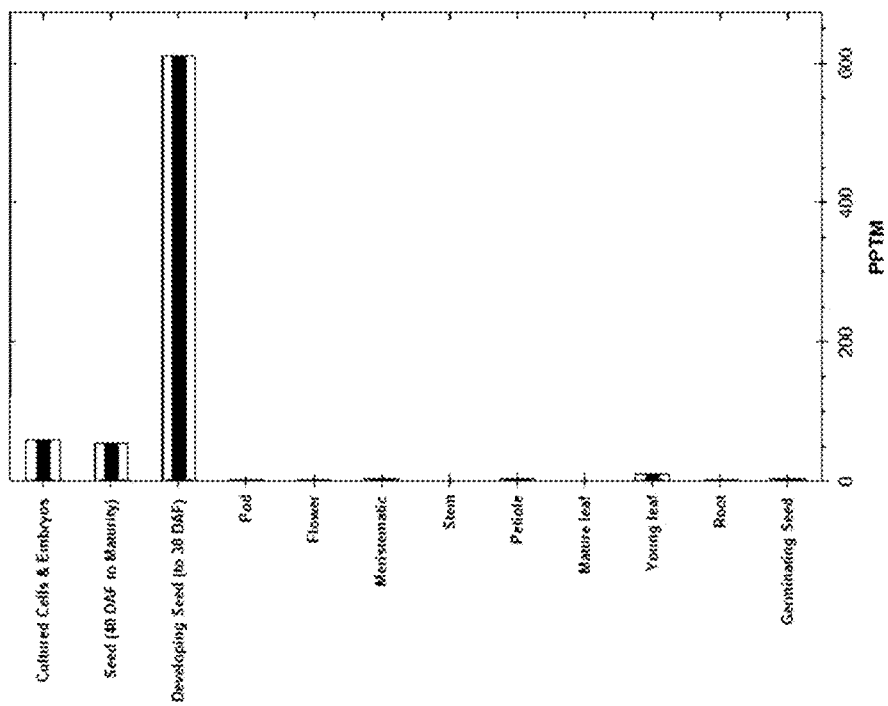
FIG. 15 shows Illumina transcript quantitation for the embryo/seed-specific gene LTP3, the respective transcript levels being indicative of promoter activity in various plant organs and different developmental stages.

Example 18. Use of the Soybean LTP3 Promoter to Control Expression of WUS for Improving Soy Transformation In order to identify new promoters that might improve transformation methods using the *Arabidopsis* WUS gene, the use of this gene was reviewed. High levels of expression for *Arabidopsis* WUS (for example, using the soybean EF1A PRO), expressed immediately after *Agrobacterium*-mediated transformation and throughout callus growth increased the rates of event formation. However, continuing to express this transcription factor at this level hindered event regeneration. Possible solutions would be to excise this gene before regeneration of plantlets and restrict the ectopic expression of *Arabidopsis* WUS in differentiating and maturing somatic embryos. Based on this, new promoters were sought that expressed in cultured cells, embryos and developing immature seeds, with none or much lower expression in other plant tissues. The soybean LTP3 promoter met these criteria, a previously unidentified soybean phospholipid transferase gene. As shown in FIG. 14 and FIG. 15, when compared to the constitutive expression of the EF1A PRO (FIG. 14), expression of LTP3 (FIG. 15) was i) strong in developing immature seeds and ii) weak or off in other samples and parts of a plant, while expression of EF1A was observed in all tissues.

The *Agrobacterium* strain AGL1, containing a T-DNA with the expression cassettes GM-LTP3 PRO::AT-WUS::UBI14 TERM+GM-UBQ PRO::TAGRFP::UBQ3 TERM, was used to transform the Pioneer soybean variety PHY21. Four days after the *Agrobacterium* infection was started, the tissue was washed with sterile culture medium to remove excess bacteria. Nine days later the tissue was moved to somatic embryo maturation medium, and 22 days later the transgenic somatic embryos were ready for dry-down. At this point, well-formed, mature somatic embryos were fluorescing red under an epifluorescence stereo-microscope with an RFP filter set. The somatic embryos that developed were functional and germinated to produce healthy plants in the greenhouse. This rapid method of producing somatic embryos and germinating to form plants reduced the typical timeframe from *Agrobacterium* infection to moving transgenic T0 plants into the greenhouse from four months (for conventional soybean transformation) to two months.

Figure 16:
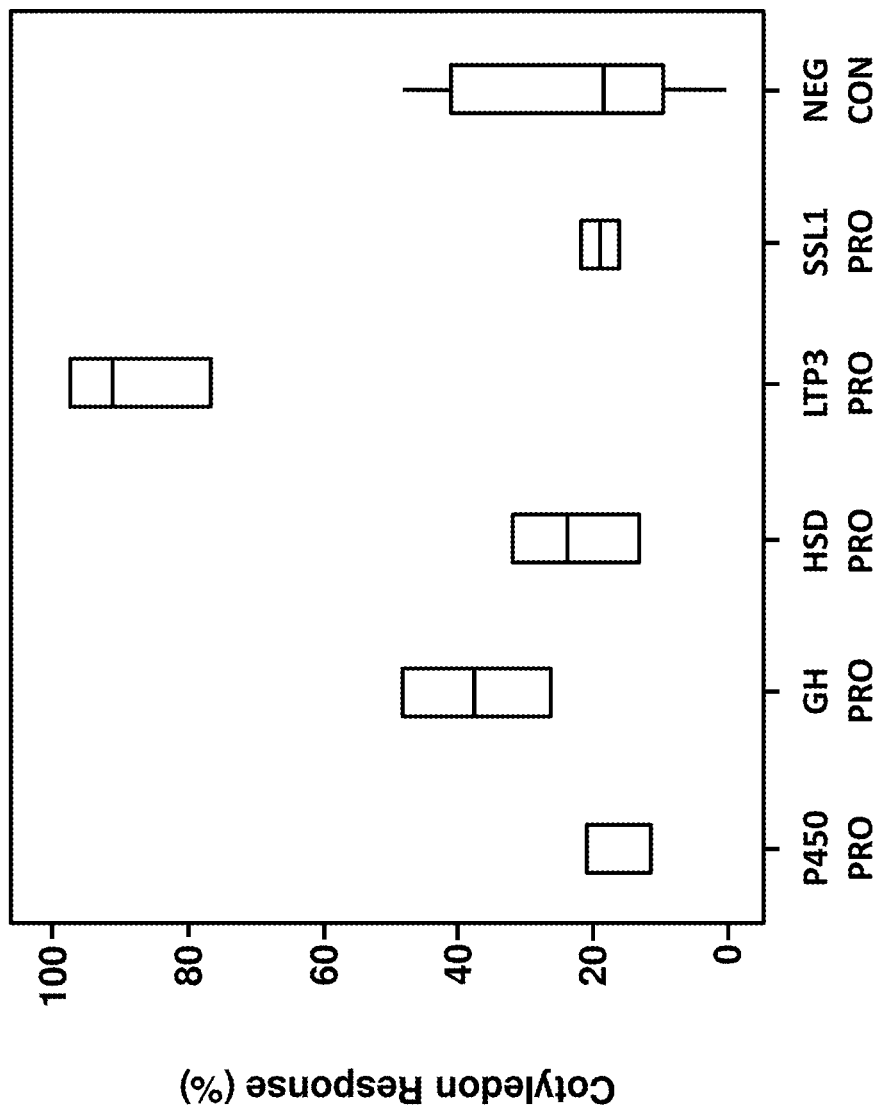
FIG. 16 shows transformation response as measured by the frequency of treated immature cotyledons that produced somatic embryos after *Agrobacterium*-mediated transformation to introduce a T-DNA containing an expression cassette with the *Arabidopsis* WUS gene behind one of five promoters; Gm-Phytochrome P450 promoter (P450 PRO); Gm-Glycosyl Hydrolase promoter (GH PRO); Gm-Homeodomain/Start-domain protein promoter (HSD PRO); Gm-LTP3 promoter (LTP3 PRO); Gm-Strictosidine Synthase-Like1 promoter (SSL1 PRO); the negative control with no WUS expression (NEG CON). For each promoter, the upper and lower ends of the box indicate the upper and lower quartile for the distribution of the data, while the line within the box represents the median. For the P450 PRO only two replicates were included in this analysis and thus no median was calculated.

As shown in the box plot diagram in FIG. 16 which displays the distribution of somatic embryogenesis responses of immature cotyledon explants 2 weeks after *Agrobacterium* infection, the use of the LTP3 promoter to drive expression of At-WUS resulted in a substantial improvement in somatic embryogenesis (as compared to other promoters tested, see FIG. 16) or to the negative control with no WUS expression cassette (see FIG. 16).

Figure 17B:
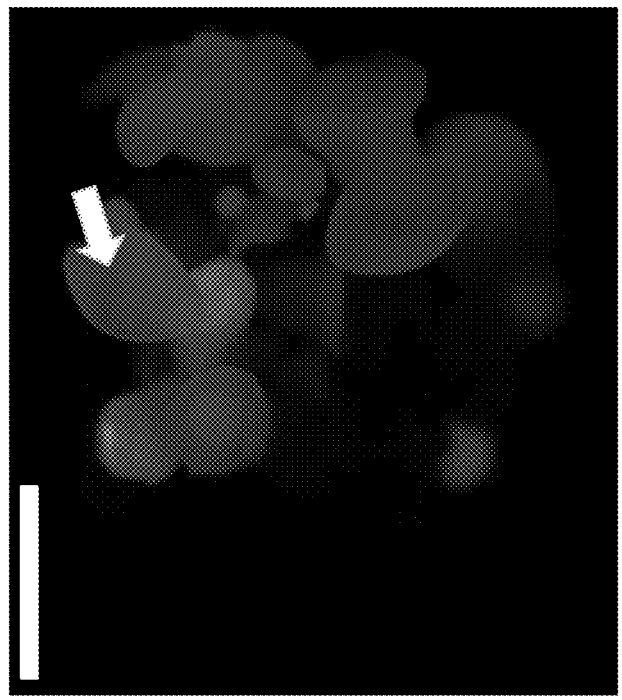
FIG. 17A shows a light micrograph and FIG. 17B shows the corresponding epifluorescence image of somatic embryos that were moved onto maturation medium to complete embryo development (shown on maturation medium 35 days after the underlying immature cotyledon was transformed with a T-DNA containing Gm-LTP3 PRO::At-WUS). Arrow points to one of the red fluorescing somatic cotyledons; the scale bars represent 2 mm in length.
Figure 17A:
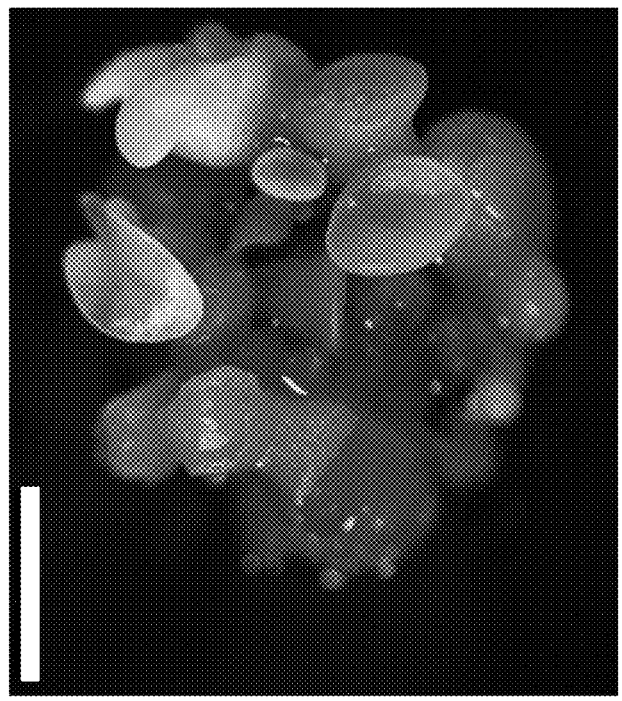

The increase in somatic embryo response across the population of infected immature cotyledons was also accompanied by rapid somatic embryo development, which was observed under both light microscopy to assess morphology (FIG. 17A) and epifluorescence to observe red fluorescence (FIG. 17B). It shows mature transgenic soybean somatic embryos that were ready for desiccation and thereafter germination only 5 weeks after *Agrobacterium* infection. When immature cotyledons were transformed without LTP3::At-WUS (control treatment) mature somatic embryos were not only produced at a greatly reduced frequency (see FIG. 16) but the duration from *Agrobacterium* infection to a comparable stage of somatic embryo maturity required nine weeks of culture.

Example 19. Excision-Activated Selectable Marker HRA to Increase the Recovery of T0 Plants in which the WUS2, ODP2 and Cre Expression Cassettes were Excised and the Remaining Trait Gene was Single Copy In order to construct a vector with excision-activated HRA expression, the HRA gene was interrupted by the ST-LS1 Intron containing a single loxP target site in the center of the intron, and was tested to demonstrate that the loxP-containing intron functioned properly. Two halves of the HRA expression cassette (split at the loxP site) were moved to opposite ends of the T-DNA with each half having it's own internal loxP site, which were closer to the center of the T-DNA than the HRA halves. Within the two loxP sites were the AXIG1 PRO::WUS2::IN2 TERM, the PLTP PRO::ODP2::OS-T28 TERM, ZM-GLB1 PRO::CRE::pinII and the SB-UBI PRO::ZS-GREEN::OS-UBI TERM expression cassettes (see PHP81814 in Table 1, and SEQ ID NO:80).

This construct produced a high frequency of rapid somatic embryo formation with excision of the combined WUS/ODP2/CRE/ZS-GREEN cassettes to activate HRA expression, and recovery of single-copy, T0 plants. In one set of experiments a combined total of 2332 immature embryos (from inbred PHH5G) were used for transformation by *Agrobacterium* strain LBA4404 THY− carrying PHP81814. Of the total embryos infected, a total of 604 T0 plants were recovered, and of these 604 T0 plants a total of 215 no longer contained the WUS2, ODP2, CRE and SZ-GREEN expression cassettes (totally excised). An overall recovery of quality events of 9.2% (number of perfect events relative to the number of starting embryos) resulted.

In a separate set of three experiments with inbred HC69, 741 immature embryos were transformed with *Agrobacterium* containing PHP81814, and produced 315 T0 plants in the greenhouse, of which 30 were single-copy for HRA with all the other genes excised for a frequency of quality events of 4%.

Example 20. Use of Promoters with Embryo-Specific Expression Patterns to Drive Expression of WUS2 and/or ODP2 to Improve Maize Transformation For these experiments, a single T-DNA configuration is used, starting with the following configuration used as a positive control: RB+ZM-AXIG1 PRO::ZM-WUS2::IN2-1 TERM+ZM-PLTP PRO::ZM-ODP2::OS-T28 TERM+GZ-W64A TERM+UBI PRO:UBI1ZM INTRON:ESR::SB-SAG12 TERM+SB-ALS PRO:: HRA::SB-PEPC1 TERM+ UBI PRO::ZS-GREEN1::PINII TERM:SB-ACTIN TERM-LB. The positive control is compared to plasmids with embryo specific promoters driving expression of WUS2 and ODP2. The plasmid PHP24600 is used as the negative control (no expression of WUS2 and ODP2 transgenes) to provide a lower baseline for comparison.

When the ZM-SRD PRO, the ZM-LGL PRO, the ZM-LEA14-A PRO or the ZM-LEA-D-34 promoters (SEQ ID NO:38, SEQ ID NO:81, SEQ ID NO:82 and SEQ ID NO:83, respectively) are used to replace the ZM-AXIG1 PRO driving expression of WUS2 in this construct, increased transformation frequencies and stimulation of rapid somatic embryogenesis is expected to be similar to that observed with the positive control vector, both being substantially greater than the negative control treatment (PHP24600). Likewise, when the ZM-SRD PRO, the ZM-LGL PRO, the ZM-LEA14-A PRO or the ZM-LEA-D-34 promoters is used to replace the ZM-PLTP PRO driving expression of ODP2 in this construct, increased transformation frequencies and stimulation of rapid somatic embryogenesis is again expected to be similar to that observed with the positive control vector, both being substantially greater than the negative control treatment (PHP24600).

Example 21. Sequence Identification

Various sequences are referenced in the disclosure. Sequence identifiers are found below in Table 18.

TABLE 18

| SEQ ID NO. | Type* | Name | Description |
|---|---|---|---|
| 1 | DNA | ZM-PLTP | *Z. mays* PLTP promoter sequence |
| 2 | DNA | SB-PLTP1 | *Sorghum biocolor* PLTP1 promoter sequence |
| 3 | DNA | ZM-WUS1 | *Z. mays* WUS1 coding sequence |
| 4 | PRT | ZM-WUS1 | *Z. mays* WUS1 protein sequence |
| 5 | DNA | ZM-WUS2 | *Z. mays* WUS2 coding sequence |
| 6 | PRT | ZM-WUS2 | *Z. mays* WUS2 protein sequence |
| 7 | DNA | ZM-WUS3 | *Z. mays* WUS3 coding sequence |
| 8 | PRT | ZM-WUS3 | *Z. mays* WUS3 protein sequence |
| 9 | DNA | ZM-WOX2A | *Z. mays* WOX2A coding sequence |
| 10 | PRT | ZM-WOX2A | *Z. mays* WOX2A protein sequence |
| 11 | DNA | ZM-WOX4 | *Z. mays* WOX4 coding sequence |
| 12 | PRT | ZM-WOX4 | *Z. mays* WOX4 protein sequence |
| 13 | DNA | ZM-WOX5A | *Z. mays* WOX5A coding sequence |
| 14 | PRT | ZM-WOX5A | *Z. mays* WOX5A protein sequence |
| 15 | DNA | ZM-WOX9 | *Z. mays* WOX9 coding sequence |
| 16 | PRT | ZM-WOX9 | *Z. mays* WOX9 protein sequence |
| 17 | DNA | ZM-ODP2 | *Z. mays* ODP2 coding sequence |
| 18 | PRT | ZM-ODP2 | *Z. mays* ODP2 protein sequence |
| 19 | DNA | ZM-BBM2 | *Z. mays* BBM2 coding sequence |
| 20 | PRT | ZM-BBM2 | *Z. mays* BBM2 protein sequence |
| 21 | DNA | ZM-ODP2 | *Z. mays* ODP2 coding sequence (synthetic) |
| 22 | DNA | PHP77833 | T-DNA sequence (RB to LB) |
| 23 | DNA | PHP78157 | T-DNA sequence (RB to LB) |
| 24 | DNA | PHP78156 | T-DNA sequence (RB to LB) |
| 25 | DNA | PHP79023 | T-DNA sequence (RB to LB) |
| 26 | DNA | PHP79024 | T-DNA sequence (RB to LB) |
| 27 | DNA | PHP79066 | T-DNA sequence (RB to LB) |
| 28 | DNA | ZM-FBP1 | *Z. mays* promoter for Fructose-1,6-bisphosphatase |
| 29 | DNA | ZM-RFP | *Z. mays* promoter for NAD(P)-binding Rossmann-Fold Protein |
| 30 | DNA | ZM-APMP | *Z. mays* promoter for adipocyte plasma membrane-associated protein-like protein |
| 31 | DNA | ZM-RfeSP | *Z. mays* promoter for Rieske [2Fe—2S] iron-sulphur domain protein |
| 32 | DNA | ZM-CRR6 | *Z. mays* promoter for Chlororespiratory reduction 6 gene |
| 33 | DNA | ZM-GLYK | *Z. mays* promoter for D-glycerate 3-kinase, chloroplastic-like protein gene |
| 34 | DNA | ZM-CAB7 | *Z. mays* promoter for Chlorophyll a-b binding protein 7, chloroplastic-like protein |
| 35 | DNA | ZM-UBR | *Z. mays* promoter for Ultraviolet-B-repressible protein gene |
| 36 | DNA | ZM-HBP | *Z. mays* promoter for Soul heme-binding family protein |
| 37 | DNA | ZM-PSAN | *Z. mays* promoter for Photosystem I reaction center subunit psi-N |
| 38 | DNA | ZM-SDR | *Z. mays* promoter for Short-chain dehydrogenase/reductase |
| 39 | DNA | AXIG1 | AXIG1 promoter sequence |
| 40 | DNA | DR5 | DR5 promoter sequence |
| 41 | DNA | PHP80334 | T-DNA sequence (RB to LB) |
| 42 | DNA | PHP80338 | T-DNA sequence (RB to LB) |
| 43 | DNA | PHP38332 | T-DNA sequence (RB to LB) |

TABLE 18-continued

| SEQ ID NO. | Type* | Name | Description |
| --- | --- | --- | --- |
| 44 | DNA | PHP80921 | T-DNA sequence (RB to LB) |
| 45 | DNA | OS-BBM1 | *Oryza sativa* BBM1 coding sequence |
| 46 | PRT | OS-BBM1 | *Oryza sativa* BBM1 protein sequence |
| 47 | DNA | OS-BBM2 | *Oryza sativa* BBM2 coding sequence |
| 48 | PRT | OS-BBM2 | *Oryza sativa* BBM2 protein sequence |
| 49 | DNA | OS-BBM3 | *Oryza sativa* BBM3 coding sequence |
| 50 | PRT | OS-BBM3 | *Oryza sativa* BBM3 protein sequence |
| 51 | DNA | SB-BBM2 | *Sorghum bicolor* BBM2 coding sequence |
| 52 | PRT | SB-BBM2 | *Sorghum bicolor* BBM2 protein sequence |
| 53 | DNA | PHP80912 | T-DNA sequence (RB to LB) |
| 54 | DNA | PHP80913 | T-DNA sequence (RB to LB) |
| 55 | DNA | ZM-PLTP1 | *Z. mays* PLTP1 promoter sequence |
| 56 | DNA | ZM-PLTP2 | *Z. mays* PLTP2 promoter sequence |
| 57 | DNA | SB-PLTP2 | *Sorghum biocolor* PLTP2 promoter sequence |
| 58 | DNA | SB-PLTP3 | *Sorghum biocolor* PLTP3 promoter sequence |
| 59 | DNA | SI-PLTP1 | *Setaria italica* PLTP promoter sequence |
| 60 | DNA | OS-PLTP1 | *Oryza sativa* PLTP promoter sequence |
| 61 | DNA | OS-PLTP2 | *Oryza sativa* PLTP2 promoter sequence |
| 62 | DNA | SB-ODP2 | *Sorghum bicolor* ODP2 coding sequence |
| 63 | PRT | SB-ODP2 | *Sorghum bicolor* ODP2 protein sequence |
| 64 | DNA | SI-ODP2 | *Setaria italica* ODP2 coding sequence |
| 65 | PRT | SI-ODP2 | *Setaria italica* ODP2 protein sequence |
| 66 | DNA | BD-ODP2 | *Brachypodium distachyum* ODP2 coding sequence |
| 67 | PRT | BD-ODP2 | *Brachypodium distachyum* ODP2 protein sequence |
| 68 | DNA | SB-ODP2 | *Sorghum bicolor* ODP2 genomic sequence |
| 69 | DNA | PHP24600 | Synthetic construct comprising the T-DNA (LB to RB) |
| 70 | DNA | PHP79530 | Synthetic construct comprising the T-DNA (LB to RB) |
| 71 | DNA | PHP79531 | Synthetic construct comprising the T-DNA (LB to RB) |
| 72 | DNA | PHP80911 | Synthetic construct comprising the T-DNA (LB to RB) |
| 73 | DNA | PHP80334 | Synthetic construct comprising the T-DNA (LB to RB) |
| 74 | DNA | PHP80558 | Synthetic construct comprising the T-DNA (LB to RB) |
| 75 | DNA | PHP80559 | Synthetic construct comprising the T-DNA (LB to RB) |
| 76 | DNA | PHP80561 | Synthetic construct comprising the T-DNA (LB to RB) |
| 77 | DNA | PHP80770 | Synthetic construct comprising the T-DNA (LB to RB) |
| 78 | DNA | PHP81430 | Synthetic construct comprising the T-DNA (LB to RB) |
| 79 | DNA | PHP81431 | Synthetic construct comprising the T-DNA (LB to RB) |
| 80 | DNA | PHP81814 | Synthetic construct comprising the T-DNA (LB to RB) |
| 81 | DNA | ZM-LGL PRO | *Z. mays* promoter for the lactoylglutathione lyase gene (ZM-LGL PRO) |
| 82 | DNA | ZM-LEA14-A PRO | *Z. mays* promoter for gene encoding late embryogenic abundant protein Lea-14-A (ZM-LEA14-A PRO) |
| 83 | DNA | ZM-LEA34-D PRO | *Z. mays* promoter for gene encoding late embryogenic abundant protein Lea34-D (ZM-LEA34-D PRO) |
| 84 | DNA | PHP80560 | Synthetic construct comprising the T-DNA (LB to RB) |
| 85 | DNA | PHP82240 | Synthetic construct comprising the T-DNA (LB to RB) |
| 86 | DNA | ZM-SDR PRO (FL) | *Z. mays* promoter for the short-chain dehydrogenase/reductase [ZM-SDR PRO (FL)] |
| 87 | DNA | OS-SDR PRO | *O. sativa* promoter for the short-chain dehydrogenase/reductase (OS-SDR PRO) |
| 88 | DNA | SB-SDR PRO | *S. Bicolor* promoter for the short-chain dehydrogenase/reductase (SB-SDR PRO) |
| 89 | DNA | RV003866 | Synthetic construct comprising the T-DNA (LB to RB) |
| 90 | DNA | RV004886 | Synthetic construct comprising the T-DNA (LB to RB) |
| 91 | DNA | RV012587 | Synthetic construct comprising the T-DNA (LB to RB) |
| 92 | DNA | RV012588 | Synthetic construct comprising the T-DNA (LB to RB) |
| 93 | DNA | RV012589 | Synthetic construct comprising the T-DNA (LB to RB) |
| 94 | DNA | RV012590 | Synthetic construct comprising the T-DNA (LB to RB) |
| 95 | DNA | RV012591 | Synthetic construct comprising the T-DNA (LB to RB) |
| 96 | DNA | RV012592 | Synthetic construct comprising the T-DNA (LB to RB) |
| 97 | DNA | RV012593 | Synthetic construct comprising the T-DNA (LB to RB) |
| 98 | DNA | RV012594 | Synthetic construct comprising the T-DNA (LB to RB) |
| 99 | DNA | RV012595 | Synthetic construct comprising the T-DNA (LB to RB) |
| 100 | DNA | RV012603 | Synthetic construct comprising the T-DNA (LB to RB) |
| 101 | DNA | RV012604 | Synthetic construct comprising the T-DNA (LB to RB) |
| 102 | DNA | RV012605 | Synthetic construct comprising the T-DNA (LB to RB) |
| 103 | DNA | RV012606 | Synthetic construct comprising the T-DNA (LB to RB) |
| 104 | DNA | RV012608 | Synthetic construct comprising the T-DNA (LB to RB) |
| 105 | DNA | PHP80730 | Synthetic construct comprising the T-DNA (LB to RB) |
| 106 | DNA | LTP3 | *G. max* promoter for the Lipid Transfer Protein gene (LTP3) |

*"DNA" indicates a polynucleotide or nucleic acid sequence; "PRT" indicates a polypeptide or protein sequence.

As used herein the singular forms "a", "an", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

All patents, publications and patent applications mentioned in the specification are indicative of the level of those skilled in the art to which this disclosure pertains. All patents, publications and patent applications are herein incorporated by reference in the entirety to the same extent as if each individual patent, publication or patent application was specifically and individually indicated to be incorporated by reference in its entirety.

Although the foregoing disclosure has been described in some detail by way of illustration and example for purposes of clarity of understanding, certain changes and modifications may be practiced within the scope of the appended claims.

SEQUENCE LISTING (106 sequences)

SEQ ID NO: 1 - DNA, 1062 bp, Zea mays
ccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaac

SEQ ID NO: 2 - DNA, 1251 bp, Sorghum bicolor
aaaatttgtttgttttgaacaaaaattgagagatttgtttttgagggtcggacacatacgagttttgggaaaccgtcggtggtacctgcctgtgcacacagaggtagctagctaggttggggacgggatgcatgtatgtaatacgtggcggagcttccgatcgagacagcgacatgtgggctcccatacttgctggacaacttaatcgctaccactgctgcaacttcaatttgtgaatgtgcatgtaacctcctgcactgtactgatatctctgtttctggttgcggccgggaggaattaacgaagactactggaaggattcatggatgatggacgatccatatataattgacgtcttaatgcaggaagagtatgtgtttattgtgcgataagcactcggatccaactgcaaactacctcacactgacacactagtgagagagagtgaatacgcctccaacttcatcagatgagagccacgtacgtccgtccctgccgactgccgccatcaccctgcctgctaagtcgtgttaggcggctgctatttaagggcgtgtttaaatgtctttaaaattctaaatgtttataagatttctcgtcgcatcgaatctttagacgcatgtacgaaacataaaatatatataaataaaaaaaaaataattaactacatagtttgtatatgtaaatcgcgagataaagtacttgttgagtctagttagtctataattaaatatttattgctaaatataaacgaaagtgttatagtataacataccctaataagttgctattgctgctgcaaatgaattcactctgcctcgatcatgccctcatcaactaaccgctgtagtattatctgtatctatctgcctcctgctcccaacacccaaccacctcctgcccagcaattaacttcgacggatggcgacgataccgtccgtcgtccatggaagatgatgttggaacatccaccatattcattcattcatatgcatgcatccaccattccaccgactgcctgcctgaaactgcatgcaatgcaacaacaccgtgcatgcatgcacatctgtcatcagcaatgacaagctactgtagctagctcccagatcagatcagatcagatcgatcgcaagcctgcctatttaaggagccacactccatctcactctcctcaccagcggctagcacttgctcacttgcattccaaagctagtacaagcaagtctcagacacccccagaacatcgacgac

SEQ ID NO: 3 - DNA, 963 bp, Zea mays
atggcggccaacgtgggcgcgggcaggagtgctggcggcggcggagccggcactggcactggcactgctgctggcagcggcggcgtgtcgacggccgtgtgccgccctagcggctcgcggtggacgccgacgccggagcagatcaggatcctcaaggagctctactacggctgcggcatccggtcgcccaactcggagcagatccagcgcatcaccgccatgctgcggcagcacggcaagatcgagggcaagaacgtcttctactggttccagaaccacaaggcccgcgagcgccagaagcgccgcctcaccaacctcgacgtcaacgtgcccgtcgccgccgacgacagcgcccaccgccttggcgtcctctcgttgtcgccttcttcaggttgttcaggcgcggcgcctccgtcgcccaccctcggcttctacgccggcggcaatggctccgctgtgatgctggacacgagttccgattggggcagcgctgctgccatggccactgaggcatgcttcatgcaggactacatgggcgtgatgggcggcgcgtcaccgtgggcatgctcctcctcgtcgtcggaggacccgatggcggcgctggcgctggcgccgaaggtgacccgggcgcccgagacgctccctctcttcccgaccggcggcggcggagacgataggcagcccccgcggccgcggcagtctgtcccagcaggcgaggccatccgcggcggcagcagcagcagcagctaccttccgttctggggtgccgcgcccaccccaactggcagtgccacttccgttgcgatccagcagcaacaccagctgatgcagatgcaagagcagtacagcttttacagcaacgcccagctgctgcccggcaccggcagccaggatgcagcagcaacatccctggagctgagcctcagctcctggtgctccccttaccctgcagggaccatgtga

SEQ ID NO: 4 - protein, 320 aa, Zea mays
MAANVGAGRSAGGGGAGTGTGTAAGSGGVSTAVCRPSGSRWTPTPEQIRILKELYYGCGIRSPNSEQIQRITAMLRQHGKIEGKNVFYWFQNHKARERQKRRLTNLDVNVPVAADDSAHRLGVLSLSPSSGCSGAAPPSPTLGFYAGGNGSAVMLDTSSDWGSAAAMATEACFMQDYMGVMGGASPWACSSSSSEDPMAALALAPKVTRAPETLPLFPTGGGGDDRQPPRPRQSVPAGEAIRGGSSSSSYLPFWGAAPTPTGSATSVAIQQQHQLMQMQEQYSFYSNAQLLPGTGSQDAAATSLELSLSSWCSPYPAGTM

SEQ ID NO: 5 - DNA, 978 bp, Zea mays
atggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccttcaggcgcggcgcctccctcgcccaccctcggcttctacgccgccggcaatggcggcggatcggctgggctgctggacacgagttccgactggggcagcagcggcgctgccatggccaccgagacatgcttcctgcaggactacatgggcgtgacggacacgggcagctcgtcgcagtggccatgcttctcgtcgtcggacacgataatggcggcggcggcggccgcggcgcgggtggcgacgacgcgggcgcccgagacactccctctcttcccgacctgcggcgacgacgacgacgacgacagccagcccccgccgcggccgcggcacgcagtcccagtcccggcaggcgagaccatccgcggcggcggcggcagcagcagcagctacttgccgttctggggtgccggtgccgcgtccacaactgccggcgccacttcttccgttgcgatccagcagcaacaccagctgcaggagcagtacagcttttacagcaacagcacccagctggccggcaccggcagccaagacgtatcggcttcagcggccgccctggagctgagcctcagctcatggtgctccccttaccctgctgcagggagcatgtga

SEQ ID NO: 6 - protein, 325 aa, Zea mays
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPSGAAPPSPTLGFYAAGNGGGSAGLLDTSSDWGSSGAAMATETCFLQDYMGVTDTGSSSQWPCFSSSDTIMAAAAAAARVATTRAPETLPLFPTCGDDDDDDSQPPPRPRHAVPVPAGETIRGGGGSSSSYLPFWGAGAASTTAGATSSVAIQQQHQLQEQYSFYSNSTQLAGTGSQDVSASAAALELSLSSWCSPYPAAGSM

SEQ ID NO: 7 - DNA, 666 bp, Zea mays
atggaggcgctgagcgggcgggtaggcgtcaagtgcgggcggtggaaccctacggcggagcaggtgaaggtcctgacggagctcttccgcgcggggctgcggacgcccagcacggagcagatccagcgcatctccacccacctcagcgccttcggcaaggtggagagcaagaacgtcttctactggttccagaaccacaaggcccgcgagcgccaccaccacaagaagcgacgccgcggcgcgtcgtcgtcctcccccgacagcggcagcggcaggggaagcaacaacgaggaagacggccgtggtgccgcctcgcagtcgcacgacgccgacgccgacgccgacctcgtgctgcaaccgccagagagcaagcgggaggccagaagctatggccaccatcaccggctcgtgacatgctacgtcagggacgtggtggagcagcaggaggcgtcgccgtcgtgggagcggccgacgagggaggtggagacgctagagctcttccccctcaagtcgtacggcgacctcgaggcggcggagaaggtccggtcgtacgtcagaggaagcggcgccaccagcgagcagtgcagggagttgtccttcttcgacgtcgtctccgccggccgggatccgccgctcgagctcaggctctgcagcttcggtccctag

SEQ ID NO: 8 - protein, 221 aa, Zea mays
MEALSGRVGVKCGRWNPTAEQVKVLTELFRAGLRTPSTEQIQRISTHLSAFGKVESKNVFYWFQNHKARERHHHKKRRRGASSSSPDSGSGRGSNNEEDGRGAASQSHDADADADLVLQPPESKREARSYGHHHRLVTCYVRDVVEQQEASPSWERPTREVETLELFPLKSYGDLEAAEKVRSYVRGSGATSEQCRELSFFDVVSAGRDPPLELRLCSFGP

SEQ ID NO: 9 - DNA, 975 bp, Zea mays
atggagacgccacagcagcaatccgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacgcccgcgtcccggcgccgcccgcgataccgatgccgatggcgccgccgccgcccgctgcatgcaacgacaacggcggcgcgcgtgtgatctacaggaacccattctacgtggctgcgccgcaggcgccccctgcaaatgccgcctactactacccacagccacagcagcagcagcagcagcaggtgacagtcatgtaccagtacccgagaatggaggtagccggccaggacaagatgatgaccagggccgcggcgcaccagcagcagcagcacaacggcgccgggcaacaaccgggacgcgccggccaccccagccgcgagacgctccagctgttcccgctccagcccaccttcgtgctgcggcacgacaaggggcgcgccgccaacggcagtaataacgactccctgacgtcgacgtcgacggcgactgcgacagcgacagcgacagcgacagcgtccgcttccatctccgaggactcggatggcctggagagcggcagctccggcaagggcgtcgaggaggcgcccgcgctgccgttctatgacttcttcgggctccagtcctccggaggccgctga

SEQ ID NO: 10 - protein, 324 aa, Zea mays
METPQQQSAAAAAAAAHGQDDGGSPPMSPASAAAAALANARWNPTKEQVAVLEGLYEHGLRTPSAEQIQQITGRLREHGAIEGKNVFYWFQNHKARQRQRQKQDSFAYFSRLLRRPPPLPVLSMPPAPPYHHARVPAPPAIPMPMAPPPPAACNDNGGARVIYRNPFYVAAPQAPPANAAYYYPQPQQQQQQQVTVMYQYPRMEVAGQDKMMTRAAAHQQQQHNGAGQQPGRAGHPSRETLQLFPLQPTFVLRHDKGRAANGSNNDSLTSTSTATATATATATASASISEDSDGLESGSSGKGVEEAPALPFYDFFGLQSSGGR

SEQ ID NO: 11 - DNA, 543 bp, Zea mays
atgcatggtgtacgtacgtatctcttaattttcattgtatcaaagctgcaggtgcaagtgccgccgacgacgacgacggtgggtggcacgacgcggtggaacccgtcgccggaccagataagggtgctggagatgctgtaccgcggggggatgcgcacgcccaactcgttccagatcgagcagatcacggaggagctcggcaagtacggccggatcgagggcaagaacgtcttctactggttccagaaccacaaggcccgcgagcgccagaagcagaagcgagctgccctcctcaccctcagcaccaccaccactgcttccacgctgctaccaccagctgctgaaaccaaggagggagtggagacgaaaaaagaagaagcgtgtgaagatgcatcgagccgcaagcggaggtgcagggcctgggaagatgtcgtcgtccatggtggcggcgacgatgccggtacggaggtagctgacgactactacaccgacgacgatgtgaccctggagctcttcccgctgcgtcctgatcaggggaaataa

SEQ ID NO: 12 - protein, 180 aa, Zea mays
MHGVRTYLLIFIVSKLQVQVPPTTTTVGGTTRWNPSPDQIRVLEMLYRGGMRTPNSFQIEQITEELGKYGRIEGKNVFYWFQNHKARERQKQKRAALLTLSTTTTASTLLPPAAETKEGVETKKEEACEDASSRKRRCRAWEDVVVHGGGDDAGTEVADDYYTDDDVTLELFPLRPDQGK

SEQ ID NO: 13 - DNA, 708 bp, Zea mays
atggacacggaggcgccgagcgggcgggtgggcgtcaagtgcgggcggtggaacccgacgccggagcaggtgaaggtcctgacggagctcttccgcgcggggctgcggacgcccagcacggaccagatccagcgcatctccgcccacctcggcgccttcggcaaggtggagagcaagaacgtcttctactggttccagaaccacaaggcccgcgagcgccaccaccacaagaagaagaagcgccgccgacgcggcgcggcaatggcatcgtcgtcctcccccgacagcggcagcggcagcgggagcagcgaggaagacggccgtgttgccgccgccgccgacgccgacctcgtgctgcaaccatcgccgggaagaagcaaaagcaaacgggaggccagaagaagctacggcggcggccaccatcgccggctcgttacatgtaagcagctagcgcacacacatcgctacgtcagggacgttgtggagcagcaggaggaggacacgtgggagcggccgacgagggaggcggtggagactctggagctcttccccctcaagtcgtacgtcgacctcgaggcggagaaggtccggcggtacgtcgtcagggccggcgccagcgagcagtgcagggacttctccttcttcgacgtgtccggcggtcgggatccgccgcttcttgagcttaggctctgcagcttcggtccctag

SEQ ID NO: 14 - protein, 235 aa, Zea mays
MDTEAPSGRVGVKCGRWNPTPEQVKVLTELFRAGLRTPSTDQIQRISAHLGAFGKVESKNVFYWFQNHKARERHHHKKKKRRRRGAAMASSSSPDSGSGSGSSEEDGRVAAAADADLVLQPSPGRSKSKREARRSYGGGHHRRLVTCKQLAHTHRYVRDVVEQQEEDTWERPTREAVETLELFPLKSYVDLEAEKVRRYVVRAGASEQCRDFSFFDVSGGRDPPLLELRLCSFGP

SEQ ID NO: 15 - DNA, 1545 bp, Zea mays
atggcctcctccttcaacaacaaaaccagtcactggccgagcatgtttaggtccaagcacgccgctgagccgtggcaggcgcagcctgacatcagcagctcgccgccgtcgctcctctcaggtggcggctctagcagcaccaccaccatcggccgctgcctcaagcaccccctctcaggttactcaggtggcgaggagcggaccccggatccgaagccccggtggaaccccaggccggagcagatccggattctggaggccatcttcaactccggcatggtcaacccgccgcgcgacgagatcccccgcatccgcatgcgcctgcaggagtacggccaggtcggcgacgccaacgtcttctactggttccagaaccgcaagtcccgctccaagaacaagcagcgcaccggacagctggggctgggccttgcgcgcgcgccgggttgcggggccgctgcgccgcccgtcacgccgcagcccttgatccagaaccaattccaggtgctcgcctcgcccgcgcaggcgccagcttcctcgtcctcgtcctcctccgaccgctcctctgggtccagcaagccggcgccgcagccgatgtccgcgacggcagcggccatgaactttccagggccgctcggcgcggcgtgtgcgcagatgtactaccaagcccaccccgtggcgccggtctcggcgttgccagcgcacaaggtgcaggaccctgtagcctccgacgagcccgtcttccagccgtggccacaaggctacttcctgtcggctgccgaggtcgccagcattctcgggggccagtacaggcacgacgtgcccgtgcagcagcagccaccggcgacgttgcctgcgggagcgttcttggggctgtacaacgaggtgacagagccgactgtcactggtcacaggacatgcgcctggggcccggcggggctcgggcagttctggcccgtgggcggcgctgatcaccatcagcaccacaagcacaataccaccgcggcgaccaacaccgtagcaagggacgcggcgcacgagcacgccacgacgctggggttgctgcagtacggcttcgaagctagcgcggccatggagacggcttccgcggcggtgccccttgctgcgtcgccgggaaccgctgcgagcgtggcgacggctgggctcacatctttgcctgcaagtactaatgctgttgtcgtcaactatgatctgctgcaaggactggcagtgcccgggtccgggtccggggccgtcggtgtcagcaccggcggtgcaccgcctgtcgccgttgccgcggcgcccacggcagcgcaggagggcgtcgtcgtagcactgtgcatcacggacagcgtcacgggcaagagcgtggcacacaacgtcgcggctgccaggctcgacgtgagggcgcagttcggcgaggcggccgttctgctccgcgccgtcggcgaccgcggcgggctcgacctcgtgcccgtccccgtcgacgcgttgggctgcacagtggagccgctccagcacggtgccttttactacgtgctggtataa

SEQ ID NO: 16 - protein, 514 aa, Zea mays
MASSFNNKTSHWPSMFRSKHAAEPWQAQPDISSSPPSLLSGGGSSSTTTIGRCLKHPLSGYSGGEERTPDPKPRWNPRPEQIRILEAIFNSGMVNPPRDEIPRIRMRLQEYGQVGDANVFYWFQNRKSRSKNKQRTGQLGLGLARAPGCGAAAPPVTPQPLIQNQFQVLASPAQAPASSSSSSSDRSSGSSKPAPQPMSATAAAMNFPGPLGAACAQMYYQAHPVAPVSALPAHKVQDPVASDEPVFQPWPQGYFLSAAEVASILGGQYRHDVPVQQQPPATLPAGAFLGLYNEVTEPTVTGHRTCAWGPAGLGQFWPVGGADHHQHHKHNTTAATNTVARDAAHEHATTLGLLQYGFEASAAMETASAAVPLAASPGTAASVATAGLTSLPASTNAVVVNYDLLQGLAVPGSGSGAVGVSTGGAPPVAVAAAPTAAQEGVVVALCITDSVTGKSVAHNVAAARLDVRAQFGEAAVLLRAVGDRGGLDLVPVPVDALGCTVEPLQHGAFYYVLV

SEQ ID NO: 17 - DNA, 2130 bp, Zea mays
atggccactgtgaacaactggctcgctttctccctctccccgcaggagctgccgccctcccagacgacggactccacgctcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaagtccaactgcaacttgatacccagcactagcagcacagtttgctacgcgagctcagctgctagcaccggctaccatcaccagctgtaccagcccaccagctccgcgctccacttcgcggactccgtcatggtggcctcctcggccggtgtccacgacggcggttccatgctcagcgcggccgccgctaacggtgtcgctggcgctgccagtgccaacggcggcggcatcgggctgtccatgatcaagaactggctgcggagccaaccggcgcccatgcagccgagggcggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggtgccgtcgtcgtcacggcgccgaaggaggatagcggtggcagcggtgttgccggtgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaaggacaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgtctcaaggaggccgaggccgcagcgtccgcgcagcaccaccacgccggcgtggtgagctacgacgtcggccgcatcgcctcgcagctcggcgacggcggagccctagcggcggcgtacggcgcgcactaccacggcgccgcctggccgaccatcgcgttccagccgggcgccgccaccacaggcctgtaccacccgtacgcgcagcagccaatgcgcggcggcgggtggtgcaagcaggagcaggaccacgcggtgatcgcggccgcgcacagcctgcaggacctccaccacttgaacctgggcgcggccggcgcgcacgactttttctcggcagggcagcaggccgccgccgcagctgcgatgcacggcctggctagcatcgacagtgcgtcgctcgagcacagcaccggctccaactccgtcgtctacaacggcggggtcggcgatagcaacggcgccagcgccgttggcagcggcggtggctacatgatgccgatgagcgctgccggagcaaccactacatcggcaatggtgagccacgagcagatgcatgcacgggcctacgacgaagccaagcaggctgctcagatggggtacgagagctacctggtgaacgcggagaacaatggtggcggaaggatgtctgcatgggggaccgtcgtctctgcagccgcggcggcagcagcaagcagcaacgacaacattgccgccgacgtcggccatggcggcgcgcagctcttcagtgtctggaacgacacttaa

SEQ ID NO: 18 - protein, 709 aa, Zea mays
MATVNNWLAFSLSPQELPPSQTTDSTLISAATADHVSGDVCFNIPQDWSMRGSELSALVAEPKLEDFLGGISFSEQHHKSNCNLIPSTSSTVCYASSAASTGYHHQLYQPTSSALHFADSVMVASSAGVHDGGSMLSAAAANGVAGAASANGGGIGLSMIKNWLRSQPAPMQPRAAAAEGAQGLSLSMNMAGTTQGAAGMPLLAGERARAPESVSTSAQGGAVVVTAPKEDSGGSGVAGALVAVSTDTGGSGGASADNTARKTVDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAATTGLYHPYAQQPMRGGGWCKQEQDHAVIAAAHSLQDLHHLNLGAAGAHDFFSAGQQAAAAAAMHGLASIDSASLEHSTGSNSVVYNGGVGDSNGASAVGSGGGYMMPMSAAGATTTSAMVSHEQMHARAYDEAKQAAQMGYESYLVNAENNGGGRMSAWGTVVSAAAAAAASSNDNIAADVGHGGAQLFSVWNDT

SEQ ID NO: 19 - DNA, 2040 bp, Zea mays
atggcttcagcgaacaactggctgggcttctcgctctcgggccaggataacccgcagcctaaccaggacagctcgcctgccgccggtatcgacatctccggcgccagcgacttctatggcctgcccacgcagcagggctccgacgggcatctcggcgtgccgggcctgcgggacgatcacgcttcttatggtatcatggaggcctacaacagggttcctcaagaaacccaagattggaacatgaggggcttggactacaacggcggtggctcggagctctcgatgcttgtggggtccagcggcggcggcgggggcaacggcaagagggccgtggaagacagcgagcccaagctcgaagatttcctcggcggcaactcgttcgtctccgatcaagatcagtccggcggttacctgttctctggagtcccgatagccagcagcgccaatagcaacagcgggagcaacaccatggagctctccatgatcaagacctggctacggaacaaccaggtggcccagccccagccgccagctccacatcagccgcagcctgaggaaatgagcaccgacgccagcggcagcagctttggatgctcggattcgatgggaaggaacagcatggtggcggctggtgggagctcgcagagcctggcgctctcgatgagcacgggctcgcacctgcccatggttgtgcccagcggcgccgccagcggagcggcctcggagagcacatcgtcggagaacaagcgagcgagcggtgccatggattcgcccggcagcgcggtagaagccgtaccgaggaagtccatcgacacgttcgggcaaaggacctctatatatcgaggtgtaacaaggcatagatggacagggcggtatgaggctcatctatgggataatagttgtagaagggaagggcagagtcgcaagggtaggcaagtttaccttggtggctatgacaaggaggacaaggcagcaagggcttacgatttggcagctctcaagtattggggcactacgacaacaacaaatttccctataagcaactacgaaaaagagctagaagaaatgaaacatatgactagacaggagtacattgcatacctaagaagaaatagcagtggattttctcgtggggcatcaaagtatcgtggagtaactagacatcatcagcatgggagatggcaagcaaggatagggagagttgcaggaaacaaggatctttacttgggcacattcagcaccgaggaggaggcggcggaggcctacgacatcgccgcgatcaagttccgcggtctcaacgccgtcaccaacttcgacatgagccgctacgacgtgaagagcatcctcgagagcagcacactgcctgtcggcggtgcggccaggcgcctcaaggacgccgtggaccacgtggaggccggcgccaccatctggcgcgccgacatggacggcgccgtgatctcccagctggccgaagccgggatgggcggctacgcctcgtacggccaccacggctggccgaccatcgcgttccagcagccgtcgccgctctccgtccactacccgtacggccagccgtcccgcgggtggtgcaaacccgagcaggacgcggccgccgccgcggcgcacagcctgcaggacctccagcagctgcacctcggcagcgcggcccacaacttcttccaggcgtcgtcgagctccacagtctacaacggcggcgccggcgccagtggtgggtaccagggcctcggtggtggcagctctttcctcatgccgtcgagcactgtcgtggcggcggccgaccaggggcacagcagcacggccaaccaggggagcacgtgcagctacggggacgaccaccaggaggggaagctcatcggttacgacgccgccatggtggcgaccgcagctggtggagacccgtacgctgcggcgaggaacgggtaccagttctcgcagggctcgggatccacggtgagcatcgcgagggcgaacgggtacgctaacaactggagctctcctttcaacaacggcatggggtga

SEQ ID NO: 20 - protein, 679 aa, Zea mays
MASANNWLGFSLSGQDNPQPNQDSSPAAGIDISGASDFYGLPTQQGSDGHLGVPGLRDDHASYGIMEAYNRVPQETQDWNMRGLDYNGGGSELSMLVGSSGGGGGNGKRAVEDSEPKLEDFLGGNSFVSDQDQSGGYLFSGVPIASSANSNSGSNTMELSMIKTWLRNNQVAQPQPPAPHQPQPEEMSTDASGSSFGCSDSMGRNSMVAAGGSSQSLALSMSTGSHLPMVVPSGAASGAASESTSSENKRASGAMDSPGSAVEAVPRKSIDTFGQRTSIYRGVTRHRWTGRYEAHLWDNSCRREGQSRKGRQVYLGGYDKEDKAARAYDLAALKYWGTTTTTNFPISNYEKELEEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKSILESSTLPVGGAARRLKDAVDHVEAGATIWRADMDGAVISQLAEAGMGGYASYGHHGWPTIAFQQPSPLSVHYPYGQPSRGWCKPEQDAAAAAAHSLQDLQQLHLGSAAHNFFQASSSSTVYNGGAGASGGYQGLGGGSSFLMPSSTVVAAADQGHSSTANQGSTCSYGDDHQEGKLIGYDAAMVATAAGGDPYAAARNGYQFSQGSGSTVSIARANGYANNWSSPFNNGMG

SEQ ID NO: 21 - DNA, 2133 bp, Zea mays
atggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaa

SEQ ID NO: 22 - DNA, 25183 bp, Artificial sequence
  Synthetic construct
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgaattcgagctcggtacggccagaatggcccggaccgaagcttcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattactctatcagtgatagagtactggcgcgccactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtacctcagccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggcattggtctgtttttgtgtctgtgtctgtgggctgtggctctgtgtgttgataactcgagcttgattgcatcagtgaactgcgacttacaacagcagacagagtgttagcagcagggaaggagaatagagaaattagggagtaaagagaacatagttgcctttcagaggacagcttagcaagataacaaaattatgttctctccttttaaggattacagaggcatagcctcagcgacgcgcgtgctagcggatccagttatcatcatcgtgttgggcttcctgggcctggcctgcctagcaggcctgtcgacagcttcagaaggggaactcgttggcggattgtccacagtagcacgtactatatgcagaaaaagtccttatgtctctcttatcattagcctattaatcatattaattcagtccacataggaccgaatttataacttaacaatcttttagtttcctgagcaatatcgttaaatcaaaacatattcttgtaccaaattttgctatcaacggttcaacgcctagttagttagcggaccgaagcttcctgaattccaggtggagctcgaattcctgcagcccctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 23 - DNA, 25183 bp, Artificial sequence
  Synthetic construct
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgaattcgagctcggtacggccagaatggcccggaccgaagcttcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattactctatcagtgatagagtactggcgcgccactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcactctatcagtgatagagtctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtacctcagccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggcattggtctgtttttgtgtctgtgtctgtgggctgtggctctgtgtgttgataactcgagcttgattgcatcagtgaactgcgacttacaacagcagacagagtgttagcagcagggaaggagaatagagaaattagggagtaaagagaacatagttgcctttcagaggacagcttagcaagataacaaaattatgttctctccttttaaggattacagaggcatagcctcagcgacgcgcgtgctagcggatccagttatcatcatcgtgttgggcttcctgggcctggcctgcctagcaggcctgtcgacagcttcagaaggggaactcgttggcggattgtccacagtagcacgtactatatgcagaaaaagtccttatgtctctcttatcattagcctattaatcatattaattcagtccacataggaccgaatttataacttaacaatcttttagtttcctgagcaatatcgttaaatcaaaacatattcttgtaccaaattttgctatcaacggttcaacgcctagttagttagcggaccgaagcttcctgaattccaggtggagctcgaattcctgcagcccctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 24 - DNA, 24405 bp, Artificial sequence
  Synthetic construct
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgaattcgagctcggtacggccagaatggcccggaccgaagcttcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattactctatcagtgatagagtactggcgcgccactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccgtcgaccggaccggctcgagccttttgtctcccttttgtctcccttttgtctcccttttgtctcgccggccttttgtctcccttttgtctcccttttgtctcccttttgtctctgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtacctcagccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggcattggtctgtttttgtgtctgtgtctgtgggctgtggctctgtgtgttgataactcgagcttgattgcatcagtgaactgcgacttacaacagcagacagagtgttagcagcagggaaggagaatagagaaattagggagtaaagagaacatagttgcctttcagaggacagcttagcaagataacaaaattatgttctctccttttaaggattacagaggcatagcctcagcgacgcgcgtgctagcggatccagttatcatcatcgtgttgggcttcctgggcctggcctgcctagcaggcctgtcgacagcttcagaaggggaactcgttggcggattgtccacagtagcacgtactatatgcagaaaaagtccttatgtctctcttatcattagcctattaatcatattaattcagtccacataggaccgaatttataacttaacaatcttttagtttcctgagcaatatcgttaaatcaaaacatattcttgtaccaaattttgctatcaacggttcaacgcctagttagttagcggaccgaagcttcctgaattccaggtggagctcgaattcctgcagcccctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 25 - DNA, 26982 bp, Artificial sequence
  Synthetic construct
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatatcgctatcaactttgtatagaaaagttgggccgaattcgagctcggtacggccagaatggcccggaccggctcgagccttttgtctcccttttgtctcccttttgtctcccttttgtctcgccggccttttgtctcccttttgtctcccttttgtctcccttttgtctctgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtaccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcactctatcagtgatagagtctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtacctcagccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggcattggtctgtttttgtgtctgtgtctgtgggctgtggctctgtgtgttgataactcgagcttgattgcatcagtgaactgcgacttacaacagcagacagagtgttagcagcagggaaggagaatagagaaattagggagtaaagagaacatagttgcctttcagaggacagcttagcaagataacaaaattatgttctctccttttaaggattacagaggcatagcctcagcgacgcgcgtgctagcggatccagttatcatcatcgtgttgggcttcctgggcctggcctgcctagcaggcctgtcgacagcttcagaaggggaactcgttggcggattgtccacagtagcacgtactatatgcagaaaaagtccttatgtctctcttatcattagcctattaatcatattaattcagtccacataggaccgaatttataacttaacaatcttttagtttcctgagcaatatcgttaaatcaaaacatattcttgtaccaaattttgctatcaacggttcaacgcctagttagttagcggaccgaagcttcctgaattccaggtggagctcgaattcctgcagcccctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 26 - DNA, 28113 bp, Artificial sequence
  Synthetic construct
ggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcactctatcagtgatagagtctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtacctcagccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggcattggtctgtttttgtgtctgtgtctgtgggctgtggctctgtgtgttgataactcgagcttgattgcatcagtgaactgcgacttacaacagcagacagagtgttagcagcagggaaggagaatagagaaattagggagtaaagagaacatagttgcctttcagaggacagcttagcaagataacaaaattatgttctctccttttaaggattacagaggcatagcctcagcgacgcgcgtgctagcggatccagttatcatcatcgtgttgggcttcctgggcctggcctgcctagcaggcctgtcgacagcttcagaaggggaactcgttggcggattgtccacagtagcacgtactatatgcagaaaaagtccttatgtctctcttatcattagcctattaatcatattaattcagtccacataggaccgaatttataacttaacaatcttttagtttcctgagcaatatcgttaaatcaaaacatattcttgtaccaaattttgctatcaacggttcaacgcctagttagttagcggaccgaagcttcctgaattccaggtggagctcgaattcctgcagcccctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgggcccaggtagaatccgcctgagtcgcaagggtgacttcgcctatattggacgacggcgcgcagagggcgacctctttttgggttacgattgtaggattatcactaaaacaatacatgaacatattcaaatggcaatctctctaaggcattggaaataaatacaaataacagttgggtggagtttttcgacctgtgggcgttaaccttctgttaacctaaaagctcttgcccaaacagcagaatcggcgctaattgccagcggcggaacttttccagtttcgcgaaaaatatcgccactggcaaggaatgggtttgagatggcgaagtctgtcctaaaagcagcgcctgtagttgtagggttgacggccttgatggagcgtcatgccgatgccctctcgagccaacttcaagcacatcatcttaaggttttcccgccgcattccgagaagggcattcgaacattcgggccatcggaggcgtccaagctgctcggcgttggcgagtcatatttacggcagaccgcgtctgagatgccagagttgaatgttagcatgagcccgggtggcaggcgaatgttctcaattgaagatatccatgcgattcggaagtatatggatcaggtcggccgcgggaaccggcgctacctgccacatcgtcgaggcggcgagcagcttcaggttatctctgtgatgaatttcaaaggtgggtcgggtaagaccaccaccgccgcgcatctggcgcagtacctcgctatgcgcggatatcgagtcttggccattgatctcgatcctcaagcgagcctttctgcactctttgggagccaaccggagacggacgttggcccgaacgaaacgctctacggcgctataaggtatgatgatgagcaggtggcaatcgaacgagtcgtccgagggacttacattcccgacctccacctgattcctggtaatcttgagctgatggagtttgaacacgatacgccacgcgcgctgatgaaccgcaaagagggcgacacgctcttttatggtcgcatcagccaagtaattgaagatatcgcggataactatgacgtcgtggtcatcgactgccctccccagcttgggtatctcacgctatccgcattgactgcggcgacgtccattcttgtcacggtccatccgcagatgctggatgtgatgtcgatgaaccagtttctggcaatgacatcgaaccttttgcgtgaaatcgagaatgctggcgccaagttcaagtttaattggatgcgctatctgataacccgtttcgaaccgagcgacggaccacagaaccaaatggtaggttatctgcggtcgatttttggcgaaaatgtcctcaattttccgatgcttaaaaccaccgcggtttcggacgctggcctgacaaaccagactctattcgaagtggagcgtggcctgttcacgcgctcgacctatgatcgagccttggaggcgatgaacgccgtcaacgacgagatcgaaacactgatcaaaaaagcatggggtaggcccacatgagccggaagcacatccttggcgtctcaactgacgcccctgagacgtcgcccgccgacaataggacggcaaagaaccgctccatgccgctcctcggcgtaacaaggaaggagcgcgatccggcaacgaagctcacagcgaacattggtaacgcactgcgagagcaaaacgatcgtcttagccgtgccgaagagatcgagcggcgtctcgctgaaggtcaggcagtgatagagttggatgcctcgtcaatagaaccgtctttcgtgcaggatcgtatgcgaggggacattgacgggctccttacttcgatccgggaacaaggacagcaagtcccaatccttgtgcgaccgcatccgagccagccgggccgatatcaggttgccttcggccaccgccggctacgcgccgtttcagaactcggacttccggtcagagcggtcgttcgcgaactgacggacgagcaagtggtcgtagcacagggtcaggaaaacaatgagcgcgaagatcttaccttcatcgaaaaggcgcgcttcgcacatcgcctgaacaggcagttttctcgagagattgtcatcgccgcgatgtcgatcgacaagagcaatttgtccaagatgcttctgctcgttgacgccctcccctctgaactgaccgatgctattggtgccgctcctggtgttggacggccgagttggcaacaacttgccgagctgattgagaaagtttcttcaccggccgacgtggctaaatatgctatgtcggaggaagttcaagcgctgccatcggcagaacgattcaaggcggtgatcgctagtctgaagcccagtcgggttgcgcgtggacttcccgaggtcatggccaccccagacggcaccagaattgcacaggtgacgcagagcaaggccaaactggaaatcacgattgacaggaaggcgacgcccgattttgcgaccttcgtgctcgatcatgtgccagcgctgtatcaagcgtaccacgctgagaaccaacggaaacggggagagtaaaccgcaaaagaaaagagccccctcaacgtcgccgtcgcggaagcccttctgtctctctagcgcgaacagaatcgcatttcctcgaatcctcgtcaagagtttttagcgccgttttggtgagctgatttcctttgcctgctgaaaggtgaaagatgatgcagacaggaagtgtaacgacgccattcgggcggcggccaatgacgcttgcgcttgtgcggcgccagacggcgctggccgatatcaaacaaggcaagacagcggacaagtggaaggtctttagagacgcgtccgcggctatggaactacttggaatccagtccaacagtcttgccgtccttgatgcgctattgagctttcacccggaaacggagttgcgtcaggaggcacagctgatcgtcttcccgtcgaatgctcagcttgcccttcgggcgcatgggatggctggcgcgactttgcgtaggcacatcgccatgctcgtggagtcaggcttgatcgtccggaaggatagcgccaacggaaagcgttacgctcgtaaggatggcgctggtcagatcgagcgcgcgtttggcttcgatttgtctccgcttctcgcgcggtcggaagagctagcgatgatggcacagcaggtgatggccgatcgagcagcattcaggatggccaaagaaagtctgacgatttgccgacgggacgttcggaagctaattacggcagctatggaagagggagcggagggcgactggcaagctgtcgaggaagtctatgtggaacttgtgggtagaattccacgcgccccgacgcttgctgatgtagagtcaattctcgaagagatgtggatgctccaggaagagataatcaaccggttggaaattagagacaattcagaaaataatagcaccaatgctgcccagagcgagcagcacatacagaattcaaaacccgaatccgttaatgaacttgaacctcgctctgaaaaggagcagggcgctaagccgagtgaaatagaccgggcaaggagcgagccgataaaagcgttccccctcgggatgatcctgaaagcatgcccgaccattggcaactatgggccgagcggtgcggttgctagctggcgtgacctcatgtcggctgcggtggtggttcggtctatgctgggggtcagcccgtcggcttaccaagacgcgtgtgaggcaatgggaccggagaatgcggcagcagcgatggcgtgcattttggagcgagcgaacttcatcaattcgcccgggggctatctccgagatctgacacggcggagcgagcttgggaagttttcacttggcccgatgataatggcgctcttgaaggctagcgggcaggggacgttgcggtttggctagaattagcgagtatggagcaggatggtctgtggtcagctgaccacagacctaataggttgaaaacatgagcgttttttggatgatcgacagaccatccgattcccggagtaccaagcgtgctctgatgggagcgataacattactcaacaagcacgaaggccccatgccgatcgttgatcgtgaaggagagcctgctctacatgcggcggtattttgccggccgaggcatgtagtcgcggagcactgcctatttactgccctaggcacaaacgttgactcttggatcgagctggcagacaaagcaataacccacacagaggacgattaatggctgacgaagagatccagaatccgccggacggtactgctgctgccgaagttgagccggctgctcctagaggtagaagagcaaagaaagcaccagccgaaacagcccgcacgggatcgttcaaatccgtgaagccgaaaacccgcggcctcagcaaccgagaaaaactggagaagatcggtcaaatcgaagctcaggtcgctggcggcgcaaccttgaaggacgccgttaagatcgtgggtatttccgttcagacctattatcaatggaagagagctgcggttcaacctgtctcacagaatccggccgtgtctgtttcagttgacgatgaactcggcgagttcatccaactcgaggaggaaaatatgcatggcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagtggacataagcctgttcggttcgtaagctgtaatgcaagtagcgtatgcgctcacgcaactggtccagaaccttgaccgaacgcagcggtggtaacggcgcagtggcggttttcatggcttgttatgactgtttttttggggtacagtctatgcctcgggcatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgacggtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactatacgtaaccaactagtgcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagcgtaccgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaag

SEQ ID NO: 27 - DNA, 13822 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcaattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 28 - DNA, 1804 bp, Zea mays
acgccggcgccacgacagccggcagcttgaaggagccagagaagtacagcgcggccgcgcgcgggcatccgctggcgctgggccgccgccctgctgccgcggaggatcttggagagcaggagctggaggatgccgccggcagcctgctgccgggcgggcttcagctcggtcgccttgttcttcttgaagcaaaatcgccccgccgccaccttccttggatcgcgcggacatccggcggcgccctccggtgacggcgaggtgggctggagtggagggagggggcggcggcggctagggttttggccgcccgtgtcgccccagtgggaggcgaccgagcgggacagttttcgcagccccgacaacccttttgtcgatatggtctgattaattgcttagcgtaaacgtgtgcagtgtcttagtatttgattatactgcacaggcaagttacatttgatatatgtttcgttgtttatgttatccatattctagctacgaggattttggatgagagcatgtctcttttttacgctatcggctatgtgcacatccttactgtctgtctgtctaatacgatcaaatctagcatactaagttactaactaatacagtacgtcattagatctgctttgagcactgtgaaaaaaaaactatataagagcctatacagttaaccaaacacaattttatcaaaaatgtaaattatgggcaaggtacaatttcattagctcccacattagtacgtgtcaatcaaaatttagaagatacggccgtcaacgtctcgtcgagtttcagcaatatgcttgtgcatagccgtataggcaatccgagcgagcactagcactttgcaaattcgaatgacagctcagtcaattcttttttgattgcagctcagtcaattctgattggcctaatcgaatatgcgctgcaaggatccggtaaactactcaggaattttgtgtgacttacaaatacccgacacacttgggccggtttggatacggtccatggaaggaagaaggcccaacttccgtctactctccccccgcacgctcggcccctcgtagtcgccgaatggctactggcgaacggcggccaggggcagcgagcagccggtggcacgccagcgacgcactcgagactcgagaggttgccgttccagcgccctctccctctctcccagctctcagcccgatgtccctctctgcgccagtcttctactgtccacagctgcagcctttgcgccttagctccgagcgcgagcagagcagggcagcgagcggccgccggcgtccgttccaagtcccacagcacttagctgtagctccgacccccagcatccctacatgagattagctgatttgtgatgtgcttcgatctaaaattttgttccattttatctttgttactagttcgagtagatggccccgcgtaacgaacgtgctgaacatgttgatgaccttattaagttgtgaaacaccttgtatatactgccttgctggtactagaaatatactgtttttttggaggatagcctatctgcgtatctgatgggtaccgtatccgtatgtatgtaaacaacatagggtgcagccatgcaagtctgatactctgatgatggctacaacgtaaagctggtgaagcaacgccgtcctcacaattcttcccccaatccacattctctcccaggctcccaaaaccacacaaacctcaacccgaaaaaagacaagatcaagccaccaccaccgccagcaagagcagaggcgagaccgcgagagtgtacgtgccaccaggagcagcagcagca

SEQ ID NO: 29 - DNA, 4263 bp, Zea mays
cctagggaaaggggcaagtattgtgcagataagaaaaatattgaatacataacatgatagttcataaaataacttattctcgttaatctgaatggtttaccaagtttgctcaattctgcctgcaaagaacgaaattctgaatgcgaaacagaaaagtaaaaaaaaaaaactaatcctactaatctgaaattctgaacggttttacaaattgagttcaaccccacctcatcatataacacaagaccttttcatggacacttcaaatatacaacatcctaaaaattgatttctgtaacaatcttgttatccatttttctgccattgctacaacagtaaaccgaatcatcacataaatgcttgttaagaggctacagaatggcaaggcaaagctactcagcttccaatatgaacaaacaagcccacatgtagcaggaagagaacagtttattaggacatgaggtaacttcagtaataataaggacaagataaaggaaacaagaaaccatattttgcaccttacaatttagaaaactagacaaggttcattttctctgcaagtagggcttgactgattccaagacaacctgaccatcagagaagctcatgaatgtttaggacatgtaaggcaaagttcgacaaggcaataaagcatgtgagcacatacccttccatcatatgacaaagaagcgaataatgatggatcatgggagctccatgcaatacctacaattttagttaaccctgtcattccttgtcaaagttctaattgataagcgaagtatgaaggttggaggataccatagatgctgtcttcatagtcagtatatgagttgagtaatggtacttcttgcctattggataaagcagaagggctgtgcaaaatgaccagggcatcaataccacaactttaaacaaaatgatctaacaagcacaagaatagagacctatcagattcaggatcgtcactgctaactttagccaaccataaatttacagttgaatctgttccagcactctacagaaggtccaatatcatcagtacacaataaaaccaatgcatcattatgttaaccctgccaaaaaagttacatgtggacggaggtaggaaggagacaaaccagaaggagctcatcatacgcaggattgtgccgaacagcccatgtcctgtaaaaataatgagaccataaaaaacccccgatctttgctagataagaaaggcaaaacaaatctgtaatcacaattgttaatgaccgaaccatttccggaaactaactctgaattggatgaaatttgctttttttggaaggtaagtgtcaaaccgacattcaccgcatatatacaaacagaatgattgagaacatttaaagattgcacattgcagtgaaaagattctggtttgagtatattattacagtacttaccaatgtgagtgcccagggagatcttttagaggatacttaagcattctgagatcccacaagcgaattccaaattcctcttctgctgttgcctgatgtttatattcgactacttatcagaagcaaacattttatttgggagcaacaatataaataagttgataataattcaataatgaactagcaatagatgtcattgttaatgaacttgaacacgggtgtccaatttgacagactctatgaattggattgggacttgctagattatattaatacaactctaaaccaaaaaaaatgaatttgttggtagaacacaatcaagagttataatcggttatttaataataacgaagcaaaaacccatgtcatatgccatacccagtgtgaacatgatatttaactactgaagcaagaaaaaaaatgcaaaatccataatcaaatataaaaaaataaaattgaaatgtaaccaagaaacaaaagatactacaaagttgatgtcttcaatgctactaaagaaagctaattcataagaatgttcgttttatgtaaaggcaacaactaatatgcaattagccaatcaagtcttgtgtgcaagtgtgcaagcgaggttcctgattcgttagataatgatccaaccatgaatcatatttaacacttaaacccttccaccaccagctcgtgtagatttatagaaaaccccataacaaaccacgatcatgtctacaattagatcataatctaacagactaagaggctcgcttgcaagcttgcacataaggtctgattgcatattagttgttgccttatgtaaatatatatgatgtattgcttgatatatgggaaacaagaaagtgtcaaactcacaacaatgttttgcttcttggggttataatccacatcccgtatatgtgcatgttcaattgcagttgattttctgggaatgatacatttaaagataaatataactgcaacatttcaataaaatgaactatagataaaagcatagtaaacaatagatcaagataatatattaactccatagaacgtagatcccacagctgaagtgatgaatcagatattgcagcaactaaattatgattgtgtggatcccaagctccaccacgtaaatttggaagcatgtcagttgatccctgtgagatcacctgtaatgcatgacattgtgaagcattaagtatataaacagatggtgtgtagattcttgacatttcataatctggtacttaagctaatgtttgaaaacagagtaagtattttgcaagtactctaatgatatattgataaaagaaggatggtgacacaccttagctattttttttgacgtgtctatgttccaaagaaaaatatttcggtcatcaatgctaattagtttatcatgctttccaagtggccaccagatcacactacaaaataaccagcttagaggtgtcaagaaccaataaagatgttacacatatcactagcagcttttaagaatacgaagcaagcaagactagtttaaaagattcatatagaaataactgtagagttaaaataaaatattctaatctattatcccttcatgagcactgtgggaaataatcctactatattgcttaaatggtgctcatggaatgtgaaacaggcgcaacatgctagacaggaaacatgttcaattgtcaattgcaccttccttggtaactatgctctcatgtgtagtgaacacgcgatatagtcacacaagtgaggccacaataatctaaccacaaataaaggccatgtgaatcaggaaagaattcaccacacaccacagagttgcatttcagctaacaaagttggacgcaactccgaaattcaaaatataggaagaatctagcacagtaagtagatcaaacatctctagaacaacaaaaaaaatcaacagaaacaggagtgcaccgtctaatcttgcccgtatgcccactaagctcaaagagctgctcaagttgtggtgagtttgattgcccattgagctccgggatcttccaaactgatgcaccatagccctcacctggtattcatatcacgaattttcaaattacaagaaaactacacactacatttttttttgttatgcaaattacaatgctcacgagtcacgaacagagacaacttttgcgttctttaccagacgtgtagactgtggagaaaaccctgtgatcgaaggggcatgatttgaggtcccaaatctcgttggggtggtagaagaggccatcgcacaccagctcgctctccgccggcgaaaaccggatcaggtgcacctacttgtatgcacgcagaggaatcgagatccaaatcaaatcccacgccatttcacctggcagaaaaagtactactcgatcgcaatcccaccaggcgcgatgagccttcatgaacgcgagacacgcacctcgttctcctccttgaggctgagggtgccggcgaggaaggtggtcgagccggcgtccgcgcgtatgtcggcgatacaccgcgcctgcaagagccgagacccgagagagcaggaagaggttaagacaggtcgttcaagaatgtttcagaaggcgctgcttgcttgcttgcctggtacttgaggccaccatacacgatgccgctggatccgccctgcattttctcgcgcgctttggatccacccggcgacgccgctgatcgctctctcccacctccgagacggaagagaccgcgggagcaggcagccgccttccacacgagtacacgacgaaccaaaagtacgatatcgcgagtgaaaacgtaattcactggaatacgtgtttaggagcagacagcgtagtagcagagaataacgaagcgg

SEQ ID NO: 30 - DNA, 1900 bp, Zea mays
aaatttcggacgaagcaatgatgaaacgctcacctgtcatcttcccatattgagatgcgagcaccttctgagcttcgttctttttttttatttactagacttgctgtgtgggtgagggaaattgaacgaacgaaattttgtgggtaattgtcatagtggatgaagatttaaaagtttatatttaaaggtgcgttttgttggagtaactagttttttaaaaaaagagttattttattatacgtttgctaaatagaatagagttaacgatcctgaggtcgagagttcgagcctctctcaccccaaatttcggacgaagcaatgatgaaacgctcacctgtcatcttcccatattgagatgcgagcaccttctgagcttcgttcttttttttttatttactagacttgctgtgtgggtgagggaaattgaacgaacgaaattttgtgggtaattgtctctcgagcctctctcaccccaaatttcggacgaagcaatgatgaaacgctcacctgtcatcttcccatattgagatgcgagcaccttctgagcttcgttcttttttttttatttactagacttgctgtgtgggtgagggaaattgaacgaacgaaattttgtgggtaattgtcatagtggatgaagatttaaaagtttatatttaaaggtgcgttttgttggagtaactagttttttaaaaaaagagttattttattatacgtttgctaaatagaatagagttactttatttttttggttagagggtagaatagaacagagttgctccgagatgtgagaaccttctgagcttcgttcatttttttttatttactagacttgctgtgtggggtgaggaaattgaacgaacgaaaatttgtgggtagttgtcatagtggatgaagatttaaaagtttagatttaaaggtgcgtttggttggagtaactagaattgtgtggtttcattctagttttttttaaaaagagttattctatgcgtttgctaaatagaatagagttactctattttttttggttgaagagtagaatagaacagagttgctccgttctctatttagttggagaaccatatgagtgtagatggtaggagagagatgagagcgctcgtatccgatggtattttggagcgggagtatttcaattatttatgatagagtttcacatgaagattctaggagtcaatctgctccttttgttgaaaactaaccatccaaaaaatagtaataaagtcactctattttttctccacggctcaatcaagcacacgattaaggttgaatgtgcacaaacacctccataaaattttcgaatttaacgatggtcggtatccatcggttgagattggtattgatggagccatccaaccaaaaaaaaaatataacgtcgcgtgaaaccgatcgatcgacaccgacgaaaccatccgagagaccgatcggtggcaccccaactgaccggtcagtcccgatcctggaccaaatcacaaccgatccgcgctggttgtctgatgctcatgcaggcgaccgaaaacgagagatcacaccgctgtgcagcagcgctgagccatatccctgaccctgacgccgctcttggctgctattgaggtgtcttctctctttggagtggacaagtcctctttgcgtgcgaatccggcgcaaacggtgaatttcagccactctctagtttcgttctctctgtcttccgaaagtgaagtgcaggaccggaaaacacagcgatttggcagggtaaaaagctccaacagccacagccgtgatcattatatcctatctatctacgctccaggctttgaggtgggtattcgaccgccaagcgccaactgcttagctcactcgtacatcgccacatcggtgaagtggtgtcgtggtgacc

SEQ ID NO: 31 - DNA, 2936 bp, Zea mays
taggcgattctagagattcgttaacacactacaagccggggttagcgttagaataaaaatccgagtccgagagagaggggaaaaacaaatcaaccaaaaatataaagcggatgacacggtgatttgttttaccgaggttcggttccaaagaacctagtccccgttgaggtggtcacaaagactgggtctctttcaaccctttccctctctgaaacggtcacttagaccgagtgagctttctccttaaccaatcgggtcacttagaccctcacaaggaccaccacacacttggtgtctcttgctttgattacaagtgtcttgagaacaagaatgaggatgaagaaagccaaccaagcaacaagagctacaaagaaacacaaatgatcctcccacaagtctaaatgcgctagagttgaataggagactttgagcggatcgatcacttgaattgtgtctttggagtggagtctattactcttgtattgaatgagtagtgaatgcttcgatggttggagtggaggtggttgtgtggtatttatagcccccaaccaccaattcaaccgttggggtaggctgctgtcgatgggcgcaccggacagtgtccggtgcgctagccacgtcacccaactgttagggttctggcggtttcgaccgttggagctttgtcctattgtgacaccggatagtccggtgccgcaccggacagacactgttcactgtttggtgcccctctgacaggcggctctaactctacgcccattgttcttcattgttcatctgacttcacggcttttgcagtcgaccattgcgcgaagtagccgttgctccgctggtgcaccggacagtccggtggcacaccggacagtccggtgaattatagcggagcgtcttttctgaaacccgaaggtggcaagttcagagtggtacggccctggtgcaccagacattgtccgatggcacaccggacagtccggtgcgccagaccagggttctcttcggtttcttttgctcctttcttttgaaccttaacttgatctttttattggtttgtgttgaacttttagcacctgtagaatatataatctagagcaaactagttagtccaattatttgtgttgggcattcaaccaccaaaatcatttatgggaaaaggttaaaccctatttccctttcaatctccccctttttggtgattgatgccaacacaaaccaaagcaaatatataagtgcagaattgaactagtttgcataaagtaagtgcataggttgcttggaatttaaaccaatattttacttttactggatatgcatggttggtttcttttatttaacattttggaccacttgttttttttgcaaattctattggaaaatcttttcaaagtatttttgcaaatagtcaatggtatatgaataagatttcgagaagcattttcaagattttgaaattttctccccctgtttcaaatgcttttcctttgacttaaacaaaactccccctgaatagaattcacctctaagttttcaagagggttttactaatttgaacaagatttagataccaatttgaaaaattcttgaaagttaacataccaaaatatatcaattgaaaattttgaaattggtggtggtggtgcggtccttttgctttgggctaatactttcccccctttggcatgaatcgccaaaaaacgaagactttgtgagcccttaaactttcttcccattggtacaagtaaatatgagcgaaagattataccaatttgagagtgatgtggagtgatggtgaagggtaaatgataccgatagagtggagtggaagccttgtcttcaccgaagactccatttccctttcaatctatgactttcgcccttgcgttcagcctccactgctgctctcctcactagcatccctcacgctgtataccttacctcagtcgtctcctccctgaagaaaccacccaaagaaactgcccaatctccaccttagtcgtctcctctcaggctctccatgatctcgctccctcacctcaatcggctcaacgatctccatgttctgctagctcgaggcgtcacgaatggagataaatacggaggtccgagcgcgcgcagacgagggagacgacatcgacgtgattcggtatttttatcattaactattatatgaaaacatcatcacacgtaagtttaatgggtccccatggggaatgggcatcctcatcaccggggagaatttttcttcgtttatatccctgtgggggaagaaacttcctcatccccatctcctaatggaagaattctccacggagaatcggcgatcagagccccattgccatctgtaagtataactaacggattaggagcatacaacattttgtttaaaaaaacaggggcaaatctacagttacactctaaaacagagacactgaaacaattgcatatatttcttaaataataattaaacattcaaaagcgtcgaggaggtcccatgcataggtttaggagcgatgataatcattctaattttcatcaaactaatttatcgaggcaaaaattagttttagataaggaagaccaacttcttggttttttaaaaaactaacaatccagttttgcaaaatctaaagcataaattagcatattaggaagcatcccagtttctaaaaattggatgctttgaggctctaaaatagttgaaaaaagagtgtgaaaaaacactaaaaactatcttgggagttacaaaaccggatgaaattggagagaataaaattctcttcttattcaatttcaaataagaaagatatcttaaaatttataatcatctccaattttatggcactctatagaaaatcggaggagatttgagagtctaaaatcaatatgattttagatctttgaaccactcctttctttggctacaaactagctctaaaata

SEQ ID NO: 32 - DNA, 1339 bp, Zea mays
agtgttgtgttttcattgttttagacttcagaacttatgtataatacttatgtctgtgtttgatacttatgtgagagcttgcggcgtttgagacttatgtttgtgtttaatacttatgttgaacacttatgtttgtgatggatatttatgtttgtggtgacagttttatgtttgtgttggctatttatgtctgtgatgatatctgtgatgtatatatgtgatatatatgtgatatcttctgtttgtgtggatggaatacaaaaaacaaataaaaaaggtatatactagtcactttgccgagtgtaacactcggcaaagaggcgctttgccgagtgtcagggtcataacactcggcaaagagcacagacctgggcaccggcttaggttctttgccgagtgttatgtcgttggcactcggcaaagaggtcggctttgccgagtgccgcacagaacactcgacaaagagcctgacatggggaccctccctggcgggttctttgccacttgggacactcggcaaagatggattctttgccgagtgctgcctggaagacactcggcaaatataacttctttgccgagtgtcaccagggacactcggcaaagccgccgtctccgtcacccggcgtcgtaacggccgcttttctttgccgagtgctctctggcactcggcaaagaggtttgccgagtgcccgagaaaaagcactcgacaaagaaggctttgccgatgcactgtttgccgagccttctttgccgagtgtaacactcggcaaagcctttgccgagtgtttttaaggcttcgccgagtacttcaggcactcggcaaagcgattgattccggtagtggatgtggtaacatcgatgcacctgaagagctatcacaagtgttgattctgacacggaagtcatcctatgatgaattaaacattatataaaatggtatatttagattttaaaagttcaccataaaaatttacgaaatagtgagcccatacaaatcttaacagacttacagtacacaaagggcaaaaactactatgcacgcttgtacataaagactgtttgcatagcagtcgttgcctacacaaaggctttaattaaatatgtcataaaaaatgtccaaacagataaaagtttttttttctgacgtgaaacgttctatagagaatcccatccgtccatctggcctcacaacagacctgcccgttgttctgctaaaaccaccaggggaaaaagtaaagagataaacggatagaacaggcgtggagcgcgcgaccccgtacgtctccaccgctgcaggaactccccccctccccggcggcccgcgcgcccaccaacc

SEQ ID NO: 33 - DNA, 3067 bp, Zea mays
agttaggtcacggttgaacaaccatggtttgtaaaagcctttgcctgtcccttcttctccttggcttgatatctctatggactttgttttgggcttgcctaaatctaaaaaggggagggatagtatttttgtggttgttgatagattctctaaaatggctcactttatcccttgtcataaaaactgatgatgctagcattgttgctgaattgttctttagaaaaatttattcgtttacatggtattccaaaacacaatagtctctgatcgcgatgctaagtttctaagccattttgtggagatctctttggaataaattgggaaactaaattgttgtttagcactacttgtcaccctcagactgatggacaaactgaggtagtaaatagaactttatctaccatgcttagggctgttttagacaagaatttgagacgttgggaggattgcttgcctcatgttgaatttgcttacaatcatgccacgcattcttctacaaagatgtgccctttccagattgtttatgggtacattcctagggcacctattgatttgatttcacttaatgccgcgaacgccccacatgtagatgcttctgcacatgttgaacaaatgattaccatacatgaacaaacgaaacagaacattgctgctactaatgcaaaaaatcaggttgctggtagtaaaggaagaaaacatgttacttttgagccaggtgatatggtttggttgcacttgagaaaggatcggtttcctactttgcggcgttctaaattaatgcctcgtgctgctggtccttttaaggtgctaacaaagattaatgataatgcttatatccttgacctgcctgcggaatttggtgtttccactagttttaatgttgcagatttgaaaccatatatggccgaggatgaggagttgtcgtcgaggacgacttcacttcaagaaggggaggatgatgaggacatcactatgagtacgaatacaccaacagcacctccacatcaagagccacttccttcattagctgggccaatcactcgggcccgtgccagagatcttaacttagtcatgctactgaagaatgagggcccagaagaatagacgaccagcccaactgcggcccatagtggacgacctagggttggccgcccctaggggctgcgccccctctatttatccaggagctgcgtctcctttattttcgagttttgttttacgttagccttagctactctcaaacacgcgcaaatctgcgctgtcttcgtgtattcagaactccaccctcgagtaatagattagattgctcgcatcttttttcttgttcgttcttcgattgcgcacaggaaacgatcttcgtgatcaggccgatctcgcatcagcaaggtcgataaccacagggagttggttcagcgattgcattggcgcctcgggcttgctcgtcgtagtcggatcgcaagggtcatcttccgccaaatcggaattatctctactcgccgaaagatcgggcacctcagcttcatcaccggtggcgcactggacagtccggtgtgacctggtgaccgtcggcacaaggcacgcgtcgcccgctgattgcacgttgattgcgctaccgaccgttggcgcgggtgtggctagctcaccggacagtctggtgcacaccgggcagtccggtgaattatagtcgtgactcctccaacttttccaagagcaccgagttcgtcgagcgcgccagccttggcaccggacactgtccggtgcacaccggacagtccggtgcactgcagactggtgcaagtctggctggatgcagccaaccttctccaatccaatctcatttgatttgacaaggttcctaacacttagaggaatatgttagtaccaaaaacaattcactaaggctagagttataccttgattcttgatttgcatctctttaacccttaacatatcaaccaaaacaatatgagttgggcatctaatcaccaaaacatttataaaaatggcccaagggcacatttccctttcatgatcaaaggcaactgccagtacaagggccatcccggaggctatactgctacaggggctcgggctcgcctctccatattacgacaatccttgtactgctgggttccctccttgcgactataaaagggggagtccagagcctgtaagggacatgggtcaacacttcaccgtttgccctccatgttcgatactggcacttgcctcaagcactcacaagatacttgtgatctactccctctcttggatagcttgtaccccgtactacgagcacttaagtgcaagataatataagtctcatcctcctattataagtatggccttctattgctcgaaccaagataaatcttgtgtcttgttatatcacccatctgaactgggacaggtagcacaaatttgctggttggttaggacccttacattgacaccattcttggagatggtttgcattcaggttttgtcctggatggaaggagggtttttgttgcatatacaaggctgatcattagggagggaagtagtaaaacgaaggaagacaggaagaacaaaacaaggactcccaatcgattgccttctccatttcatcaaggctcttttgcgggaggcgaggcatctcgccgaacaccttcccgctcggtcgttcacagcccccggctcgtgtcgtctgactgactgtgagtctgtgacgtcgctgccagtaaaccacataccaaccattgaacatcttctgtggccagccggcatccgtgcagccgccagcaccagcaggccatgacatggcaccatgtttgagctgacagctgactagctgagcgtgccgccttgccgtgtcggggagctgagctgagcctagagacgccaaacggaatggcgaaagcgaccggccgcgcggcgggcagcaggagctgcatcgagaggctgcctgcgccccgcgcccaatcctcttcctaaatcctaatcccctccgcctcatccccttcaaccccacgtctctctcgccgaaggctccggcctcgtcgggatccggtgctggattgacgca

SEQ ID NO: 34 - DNA, 1407 bp, Zea mays
gtgctaggttttcatttttttgaatttcttttcttttctagaaaacatataaataactatatttaactatttcaaaaatataataaattcactaaaaatatttacaaataaaattactagatatatatttttagaccaaagtctattatataaattaattggatttcgcaataaagaaatactacaaataaaatcctcaacaatcattagcaaacaaaatcatgctttcaaaaaaatgaatagatcaaacacttaattaaaaaataatttattcaaaagattatatatatacatatatatatatgacattattttctttattttaaaattgttttctctctactagttttagcaactaatgtttaatttcttttaagttttaattgatggatttgaggtgttacatattctatatatcggggagaatgcatgtaacttgtattatccattggtaggtcctcaatttgcttccaccatttgattcacctaaaaggccaccacccaccagtagccgagcctcagctttttctggagctggcaagcagccctcatggacctcatgtgatttatattcacccaaaaaaagtttttcagaaaagaatttgtatatattttcgtcaactctattttatctctcttgccattaacatcgtgtcactggatctaatacgtgatacgttgtgttaaaacattgcgagaacttattttttttcttcttttgtgatatgggaggcaaatctgtcttttttttttgtcatggggttttgatttatatggaggggaagtgaaatgaaaccttttttttttgccaccgatgccttctattctatctggtgcctcttgttcgccgcggggctgcagcctgcaggtagtcaggcatcgccggcagttccatttccatgacaacgcgtcgtccgcccggggtactggcctgattcgggcacccagaaagtttggcctttcttttgacagttgaaacaagttttccaaattttttttggccatgtattactataaacaaggtttcgccatttgcctatgtttattaggaagttacatccggtttgctgctgccaccattttgtcagcccgtcacattcatatcttttatatggctattgctcttcctttttgtaaagccgaatgaatccgcgcgcgacatggcactttgccgatagctgagcaccctccacgtcagcgcgatccggcgcgccagagccaaacgagcagattctcccgcgccgcgtggcacgaggcggccgcgcccgctatcccctcgcggataaagccggacccactccggcgcgcgcgcaccacgagatcccttaaactgccgggcatcacccaccagcccaccgccaccacacagctcccacgctcaccgacgccacagcttgtgcgcgcgca

SEQ ID NO: 35 - DNA, 10000 bp, Zea mays
acaactacaagccgggttagcgttagaaatataaacgagttcgcaagagagggtgaaaaacaaatcgcaagcaaatgaagtgtgtgacacgcggatttgttttaccgaggttcggttctcgcaaacctactccccgttgaggaggccacaaaggtcgggtctctttcaacccttccctctctcaaacgatccctcggaccgagtgagcttctcttctcaaatcaaaaccgggatcaaaacttccccacaagggccaccacacacttggtgcctcttgccttgattacaatggaattttgatcacaagaacaagtgagaaagaaaagaagcaatccaagcgcaagagctcaaaagaacacgggaaatctctctcgctaatcacttaagccttgagtggaattggagaggatttgatctctttggtgtgtctagaattgaatgcctagctcttgtaagtggttgagaagtggaaaacttggatgcaatgaatggtgggggtggttggggtatttatagcctcaaccaccaaacttgaccattggtggaggctgtctgtcgatggcgcaccggacagtccggtgcacaccggacatgtccggtgccccagccacgtcaccaatgccgttggattccgaccgttggagttctgatttctgggcccgccttgatgtccggtggcgcaccggacatgtactgttgagtgttcggtgcgccagtatgggcacgcctgacttctgcgcgcctagcgcgcgcatttaatgcgtcgcaggtagccgttggcgcgaagtagccgttgctccggagttgcaccggacagtccggtgtacaccggacatgtccggtgaattatagcggagcagccgttctgatttcccgaggctggcgagttcctgaggcagctcttcagaggagcaccggacactgtccggtgtacaccggacagtccggtgaattatagcgcgagtgcctctggaaattcccgaaggtggcaagtttgagttggagtcctctggtgcaccggacactgtccggtgccccagaccagagatgccttcggttgtccctttgctcctttgttgaatccaatatttgatctttttattggctaagtgtgaaccttttacacctgtataacttatacactagagcaaactagttagtccaattatttgtgttgggcaattcaaccaccaaaattatttgggaactaggtgtaagcctaattccctttcaatctccccctttttggtgattgatgccaacacaaaccaaagcaaatatagaagtgcataattgaactagtttgcataatgtaagtgcaaaggttgcttggaattgagccaatataaatacttacaagatatgcatggatcgtttctttgtttttaacattttggaccacgctcgcaccacatgttttgtttttgcaaattcttttttgtaaatccttttcaaagttcttttgcaaatagtcaaaggtaaatgaataagattttgcaaagcattttcaagatttgaaattttctccccctgtttcaaatgcttttcttttgactaaacaaaactccccctaaatgagatcctcctcttagtgttcaagagggttttgatatatcattttgaaatactattttctcccccttttgaacacaataggataccaattgaaaatactatttggaaaactaagtttttgaaattggtggtggtgcggtccttttgctttgggctcttactctctccccctttggcatgaatcgccaaaaacggaatcattagagccctcgaagtgctttcttcctcttttggtcataaataaatgagttaagattataccaaagacgaagtccttttgctttgtgctcatgctttctcccccaagaatggagagaggcgtggagcgacggcgaaggatgagatacgtagtggaagcctttgtcttcgccgaagactccaattccctttcaatattcctatgacttggtttgaaatagacttggaaacatattagtcatagcatatgaaggagacatgatcaaaggtatataaaagagctatgtgtgcaatctagcaaaagaaattgcgcgaatcaagaatattgagctcatgcctaagtgtgttgaaagtttgttcatcaagaggcttggtaaagatatcggctaattgatctttagtattaatgtaagaaatctcgatatctcccttttgttggtgatccctaagaaaatgataccgaatggctatgtgtttagtgcggctatgctcgacgggattatccgccatcttgattgcactctcattatcacatagcaaagggactttggttaatttgtaaccgtagtcccgcagggtttgcctcatccaaagcaattgcgcgcaacaatggcctgcggcaatgtactcggcttcggcggtggaaagagcaaccgaattttgcttctttgaagcccaagacaccaaggatcttcccaagaactggcaagtccccgatgtgctctttctattgattttgcaccctgcccaatcggcatccgaatagccaatcaagtcaaatgtggatcccctaggataccaaagcccaaacttaggagtataagccaaatatctcaagattcgtttcacggccataaggtgagcttccttaggatcggcttggaatcttgcacacatgcatacggaaagcataatatccggtcgagatgcacataagtagagtaaagaacctatcatcgaccggtataccttttgatccacagacttacctcctgtgtcgaggtcgagatgcccattagttcccatgggtgtcttgatgggcttggcatccttcattccaaacttgcttagaatatcttgagtgtacttggtttggcttaggaaggtgccctcttggaattgctttacttgaaatcctaagaaatacttcaactcccccatcatagacatctcgaacttttgtgtcatgatcctactaaattcttcacatgtagacttgttagtagacccaaatataatatcatcaacataaatttggcatacaaacaagtcattatcaagagttttggtaaagagcgtaggatcggcttttccgactttgaagccattagcaataaggaaatctctaaggcattcataccatgctcttggtgcttgcttgagcccataaagcgccttagagagcttatagacatggttagggtactcactgtcttcaaagccgggaggttgctcaacatagacctcttccttgattggtccattgaggaaggcacttttcacgtccatttgataaagcttaaagccatggttagtagcataggccaataatatgcgaattgactcaagtctagctacgggtgcataggtttcaccgaaatccaaaccttcgacttgggagtatcccttggccacaagtcgggctttgttccttgtcaccacaccatgctcatcttgcttgttgcggaagacccatttggttcctacaacattttgattaggacgtggaactaaatgccataccttattcctagtgaagttgttgagctcctcttgcatcgccaccacccaatccgaatcttggagtgcttcctctaccctgtgtggctcaatagaggaaacaaaagagtaatgctcacaaaaatgtgcaactcgatatctagtagttacccccttatgaatgtcgccgaggatggtgtcgacggggtgatctcgttggattgcttggtggactctcgggtgtggcggtctttgctcttcatcctccttgtcttcttcatttgcatctcccccttgatcattgccatcattttgaggtggctcatttgcttgatcttctacttcatcaacttgagcttcatcctcattttgagttggtggagatgcttgcatggaggaggatggttgatcttgtgtatttggaggctcttcggattccttaggacacacatccccaatggacatgttccttagcgcgatgcatggagcctcttcatcaccggttaggagttcataggatgtcttcttgaggattcggtgtagatataaccggttgatggcgtagcaggcggtgttgaccgcctcggcccaaaaccgatccaaagtcttgtactcatcaagcatggtccttgccatgtccaatagagttcgattcttcctctccactacaccattttgttgtggcgtgtagggagaagagaactcatgtttgatgccctcctcctcaagaaaaccttcaatttgagagttcttgaactccgtcccgttgtcgcttcttattttcttgatccttaagccgaactcattttgagcccgtctcaagaatccctttaaggtctcttgggtttgagatttttcttgcaaaaagaatacccaagtgaaacgagaataatcatccactattacaagacaatacttactcccgccgatgcttatgtaagcaatcgagccgaatagatccatgtggagtagctcaagcggcctgtcggtcgtcatgatgttcttgtgtggatgatgggcaccaacttgctttcctgcttggcatgcgctacaaaccctgtctttctcaaaatgaacattggttagtcctaaaacgtgctctccctttagaagcttatgaagattcttcatcccaacatgggctagtcggcggtgctagagccaacccatgttagtcttagcaattaagcatgtgtcgagttcagctctatcaaaatctactaagtatagctgaccctctaacacacccttaaatgctattgaatcatcacttcttctaaagacagtgacacctgtatcagtgaaaagacagttgtagcccattttgcataattgagatacagaaagcaaattgtaatctaatgaatctacaagaaaaacgttggaaatagaatggtcaggagatatagcaatcttaccaagacctttgaccaaagcttgatttccatccccgaatgtgatagctcgttggggatcttggtttttctcataggaggagaacattttcttctcccctgtcatgtggtttgtgcaccctctgtcgatgatctaacttgagcccccggatgcataaacctacaaaacaattttagttcttgactttaggtacccaaacggttttgggtcctttggcattagaaacaagaactttgggtacccaaacacaagtcttggagcccctgtgtttgcccccaacaaacttggcaactactttgccggatttgttagtcaaaacataagatgcatcaaaagtcttaaatgaaatgtcatgctcatttgatgcactaggagttttccttttaggcaacttagcacgggttggttgcctagagctagatgtctcacacttatacaaaaatgcatgattagggccagagtgagacttcctagaatgaattctcctaatcttgctctcaggataaccggcaggatataaaatgtaactctcgttatcctgaggcatgggagccttgccctttacaaaattagacaatcttttaggaggggcattaagtttgacattgtctcccctttggaagccaatgccatccttgatgccagggcgtctcccattatagagcatacttctagcaaatttaaatttttcattttctaagttatgctcggcaattttagcacctaatattgctatgtgatcattttgttgtttaattaaagccatgtgatcatgaatagcattgatatcaacatctctacatctagtacaaatagaagtgtgctcaacggtagatgtagagggtttgcaggatttgagttctacaaccttagcatgcaacatatcattcttagttctaaggtcggaaattgtagcattgcaaacatcaaaatctttagccttagcaatcaaattttcattttctactctaagactagcaagagaattgttcaattcttcaatcctagcaagcaaatcaacattatcatctctaggattggaagttgaaacaatacaaacatgagaatcaaccttagctaacaaattagcattttcatttctaaggttgtctattgtttcatggcaagtgcttagctcactagataatttttcacttttctcaatttctagagcataagcatttttaaccttaacatgtttcttattttccttaatcaggaagtcctcttgggaatccaaaaggtcatccttttcatgaatggcactaattaattcatttaatttttccttttgttccatgttaaggttggcaaaaagggtacgcaaattatcttcctcatcactagcattatcatcactagaggactcatatctagtggaggatttagatttaaccttcttccttttgccgtcctttgccatgaggcacttgtggccaacgttggggaagaggagtcccttggtgacggcgatgttggcggcgtcctcgtcgtcggaggagtcggtggagctctcgtcggagtcccactcacggcacatgtgggcatcgccgcccctcttcttgtggtacctcttcttttctctcctcttgccctttttgtcgttatccctgtcactgtcacttgataatggacatttagctataaagtgaccgggcttaccacacttgtagcaaaccttcttggaatgggatttgtaatccttccccttccgttgcttgaggatttggcgaaagcttttgatgattaaagccatctcctcgttgtcgagctttgaagcgtcgattggttgtctactcggtgtagactcctccttcttctcctccgtcgccttgaatgccaccggttgtgcttcggacgtggagggatcatcaagctcgttgatcttctttgagcccttgatcatacattcaaagctcacaaaattcccgataacttcctcgggggtcattgatgtatatctaggattaccacgaattaattgaacttgagtggggttaaggaagatgagtgatctaagaataaccttaaccacctcgtggtcatcccatttcttgctcccgaggttgcgcacttggttcaccaaagttttgagccggttgtacatatcttgtggctcctccccttggcgaagacggaagcgaccgagctccccctcgatcgtttcccgcttggtaatcttggtgagttcatctccctcgtgcgcggtcttgagtaagtcccaaatttcctttgcattcttcaacccttgcaccttgttatattcctccttgcttagagaggcgaggagtatggttgtagcttgagagttgaagtgctcgatttgggccacttcgtcctcatcatagtcttcatcccctacggatggtacctatgcaccaaactcaacaacatcccatatgctttttgtggagtgaggttagatgaaatcgcattaaatcactccacctagagtaatcttcaccatcaaatgttggtggtttgcctaatggaacggaaagcaaaggtgtatgtttggaaatgcgagggtagcgtagggggatcttactatacttcttgcgctcttggcgcttagaagtgacggatgccgcgtcggagccggaggtggatggcgatgaagaatcggtctcgtagtagaccactttcctcatcctctttttcttgtccccactccgacgcgtcttgtgagaagaggatttctccttcttctccttttggtgtgaagaagacttcttctccttccctttggaggagttcttcttctccttcctcttggtgcgggactcttccgatgaagtgctcccatggcttgtagtgggcttttcgctggtctccatctccttcttggcgtgatctcccgacatcacttcgagcggttaggctctaatgaagcaccgggctctgataccaattgatagtcgcctagagggggggtgaatagggcgaaactgaaatttacaaatataaacacaactacaagccgggttagcgttagaaatataaacgagttcgcaagagagggtgaaaaacaaatcgcaagcaaatgaagtgtgtgacacgcggatttgttttaccgaggttcggttctcgcaaacctactccccgttgaggaggccacaaaggccgggtctctttcaacccttccctctctcaaacgatccctcggaccgagtgagcttctcttctcaaatcaaaaccgggaacaaaacttccccacaagggccaccacacacttggtgcctcttgccttgattacaatggagttttgatcacaagaacaagtgagaaagaaaagaagcaatccaagcgcaagagctcaaaagaacacggcaaatctctctcgctaatcactaaagccttgagtggaattggagaggatttgatctctttggtgtgtctagaattgaatgcctagctcttgtaagtggttgagaagtggaaaacttggatgcaatgaatggtggggtggttggggtatttatagcctcaaccaccaaacttgaccgttggtggaggttgtctgtcgatggcgcaccggacagtccggtgcacaccggacatgtccggtgccccagccacatcaccaatgccgttggattccgaccgttggagttctgatttctgggcccgccttgatgtccggtggcgcaccggacatgtactgttgagtgtccagtgcgccagtatgggcacgcctgacttctgcgcgcgcatttaatgcgtcgcaggtagccgctggcgcgaagtagccgttgctccggagttgcaccggacagtccggtgtacaccggacatgtccggtgaattatagcggagcagccgttctgatttcccgaggctggcgagttcctgaggcagctcttcagaggagcaccggacactgtccggtgtacaccggacagtccggtgaattatagcgcgagtgcctctggaaattcccgaatgtggcaagtttgagttggagtcctctggtgcaccggacactgtccggtggtgcaccggacattgtccggtgtacaccggacagtccggtgccccagaccagagatgccttcggttgtccctttgctcctttgttgaatccaatatttgatctttttattggctaagtgtgaaccttttacacctgtataacttatacactagagcaaactagttagtccaattatttgtgttgggcaattcaaccaccaaaattatttgggaactaggtgtaagcctaattccctttcagtttggcggtggtaaaagttggttcggcggtggtaaaaggaacgtgtgcgcctaatagcgaggtaaattaggacaactatttccgcactaatctatgacttctattttttgcttaaataaaatctatgcaaatattcaagcatccaaagagttgtaactaaggttttattcaagtgttgatatatgtattgtaaaaggtcttttgtaacctagatcaccgattgttttctgagcatttagatgtctagagctatgttattaaagtctcaactcacttattatgtttgtcagctcctacatttgagaaatgacccgttagagtggagtcaacaacattggcattcaaaccccagagtggccattacgatttatgtgtagctgtgcgcctgtgccttaagtcttactctctccgtttctttttatttgtcgctggatagcgcaattttttacactatccagcgacaaataaaaagaaacggagggagtaacaatctgtaacatgctgctaacatttgggtggctttgcgttctgcttgttgggcccggctctgaaatgagcagtctagaagccaacggcccaacacagagcagctaattcgggcctccacgctacggctatggcttctcagttctcatctccaactacgcaccagatgccaggtggcgataagaccttatcctgcgcggctacttggcgcgagggcggccatccacgtcagacgagcgcgctgacctggcgcccctccagctcatcctatctacatatcagtgtccctctccctggcccagccgctcctaccatcagaatcagaccaccacacgcccgaggcccgactgcaagcgcctgagcccaagaccc

SEQ ID NO: 36 - DNA, 1663 bp, Zea mays
gatattgaagtctagaattagaaattggaaccaagattcctaaattatgttgtttgcttgtataatgaatttatagtttaaattaaagttcaattcctcagtattagactataactagaagttgtctcacataatttagagaatagaccttctgtattggttggaattgcaattccagatacatccaaacaacagatttatattgcaactcatttccaatatcaagaagatttagtattaatctaatttaattctaccatccttaatgcctacatccaaacagacactgaagggaatttttttggttggtcatagggttgaaaacgaacgggtaaaatctcgtcccgatccgtaccgttttccatatttgattctctcgttttttaaatttgtggaaaatccataaatagttcgaaaacgagagacggtcgggttgaacccgtatttgagaaatccaagatcagcccaatatatattagtgcattagttaaagcctcatatccttatatgacaaattatatcacaagaggtcgttatagccatcgactcagtgacaagtggtctaaagacttaaacaacaccactcatagctataagtacatcataaacaagcaaacaacaactaagtgttacctctatgtatctatttgtttcatgttattatcttgccattcaataactaactaaccaccaatattagtgtgtttgtataagttacaagtttcggcttaatattcacgtcccttttttacacccatttattctacatctattttcgttcctggctattctagacctggtctcgttttcaccaataaaatacggaaatggaaacgagaggggttttctgtctattttcgttcgtttttatagtcggtcatgtgttgcaagtataggtgaccagatgggtcaagttatatgggacgacacgaggcaccaccattttggccggcatgagacccatcatgggtcgtgcttggacttaggtacaagcccattgggcgacacaggcacgacctatttactgtcagctcatttagcacgatgctaatcacggatagcccatcaaaccgaccacgacttagcatgacccgtttgtggcctagtcttgtcctaatctaggccaccataatatatataaatatgaccaactcaatccccactttcatctattttcgagttctgtaaaaaaatgagaaaaataagcaacaaaaaataggaaaaataaattattttcaagctatgttataaggcagacctttggtcactcagaaccttagcacgatacgacatgatagtctatcataacccgttttaaattagtagggttatgtttgggctcagacttcggctcacggacagacaccataaccccgcccgctatttatctgtaccgtgtctcggatcgattaaatcggcacggcccatgacgggctccggccgtgcttgcacggcactgtccattagccacgtgtagttgcaaggtgtgacgagtgttaacttcacccgtccaatcgattttaacacgcgggggcctgcggttagagattggacaaggcccgccagtaatcttctggtccaaatgttaacacgcgcgcaattgtaaaagaaatatatgtctatatagtaaaacgcgaagagagagatacttctgcggaaacga

SEQ ID NO: 37 - DNA, 919 bp, Zea mays
ttggggaggtggagtccgacggtgcggtgggggaggagatggagtccaatggtggggtggaggagagggaggggaggccgccggagttgagcacagtggaggaagctgcgcgagcccgtggctgcaaccgccggcggtgattaggtcaaatgcgagaacgcggtcggccatgggctgcacgctaggatggtgggctgcacgatgggacgatgggccttaggcccacacgaaaatcattggaccgcccgaaccgctgccacaggcgcgctggtatgctatctattttattagtgccacatcgtccattgagagtgacggaacatggcttataagcgcagttgtgtattgtgtgttgctcactaagagagatggaactggatgtggctcaaaaacttgtgtatgtactgtttattttgttactcaggactgcatggtgcgtatggccggtggggcccacatgtagcggctgttggaggcagaacaacagttggcagaacgcgtcggaggcagaacacgtcagaggcagactactattgcagtcttaataagtagtagagaaatagaagtgaaatggagttagagcatctgaaagccagaggcttccatgcaggccacctaagcaataccttcctctatatttgcatgcccaagagtcacctgcacgtgtcacacggacccatcgccatttggataatgggtgccacgtgtgaaaaagcccagccaatgggatggaagcagagcctcacgccctatccatacgacaaccacaacccccctcccgcctcagtttcctccaccggacacctgctgccacccacacgatcaaaaacaaaaccaagctccaagcacccatagccacacaccacaccaggtcaaagcaaggagctcgatcgagagcaacaagccaacaacggccatc

SEQ ID NO: 38 - DNA, 751 bp, Zea mays
cccacagagataaaagttctccactatgtatgtatgttgttttaaactgtagtcatagaagaagtcaccgtgctcactgataggagggtctaaaagtagatgcattaatcaaaaacaaaacatacatcattgaactttaaaagcatataaccttcaatactaaataaaaagattagtattgtttaaatattagatactactgataaaaaagataaacaccattagctatattaccaccctctccaactgttttctgaactaattgtaaatgggcccatagtgtagtcgtcaagcatggaggcccgctcgaccgacctcctcgatcgctcaaatttggaaacagcggttgctactgaccggggtgagtgctgcgttgttggcgactgccctgttttttaatggattcagtgagagctaaaaagtgcgagactgcgagagaaatccagcaggtgtacgtacgtaaagcgagagtcgacgcgtgggcgcggcagacgcgagcctcccgccacgttggcctcgttcccgcgccacgcggccacgcctgcctgcctcctcaccttgtttatatgcctcgcgcctccctcaccgtgccaatgccgcaggtgtacgtacgtaaagcgagagtcgacgcgtgggcgcggcagacgcgagcctcccgccacgttggcctcgttcccgcgccacgcggccacgcctgcctgcctcctcaccttgtttatatgcctcgcgcctccctcaccgtgccaatgcc

SEQ ID NO: 39 - DNA, 1311 bp, Zea mays
aggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcc

SEQ ID NO: 40 - DNA, 229 bp, Artificial sequence
  Synthetic construct
ccttttgtctcccttttgtctcccttttgtctcccttttgtctcgccggccttttgtctcccttttgtctcccttttgtctcccttttgtctctgacagtggtcccaaagatggacccccacccacgaggagcatcgtggaaaaagaagacgttccaaccacgtcttcaaagcaagtggattgatgtgatatctccactgacgtaagggatgacgcacaatcccactag

SEQ ID NO: 41 - DNA, 22782 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcactctatcagtgatagagtctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccccgggcacccagctttcttgtacaaagtgggtacaaaaaagcaggctccataggattggggccagaatggcccaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgggcctagaaggccagcttcggccgccccgggtctagaggatccagaagaccaaagggcaattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacgacctgcaggtcgacggatcaagtgcaaaggtccgccttgtttctcctctgtctcttgatctgactaatcttggtttatgattcgttgagtaattttggggaaagcttcgtccacagtttttttttcgatgaacagtgccgcagtggcgctgatcttgtatgctatcctgcaatcgtggtgaacttatttcttttatatccttcactcccatgaaaaggctagtaatctttctcgatgtaacatcgtccagcactgctattaccgtgtggtccatccgacagtctggctgaacacatcatacgatattgagcaaagatcgatctatcttccctgttctttaatgaaagacgtcattttcatcagtatgatctaagaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtacctcagccgtcaacagccagggtgattagagccccagcatgcaaaatgatcacctggtcgctcatccttgactaaagcatggctcggcggtcgctgtttacctatatccctatagtaggtactcctgtacataaagcctgaaaaaatgggttcagttgtttatcgaactctgccaaatttgcttttgcatataatgtaaaattcagctagctctgctaagctcctcgcttcagttcgacagaactgcaattgatattgatgttatggaaattgatattggaacaatcagcaatattatgcttatattcatttcttgggcgtgctctactctgtgccgatgatatcatccgatgggttttgtacttcttacttatgaagtgaacgataataggttgcctggtcccagttctcagcttgatgttatgataatcatatgtgatttcagttctttgtctggcattggtctgtttttgtgtctgtgtctgtgggctgtggctctgtgtgttgataactcgagcttgattgcatcagtgaactgcgacttacaacagcagacagagtgttagcagcagggaaggagaatagagaaattagggagtaaagagaacatagttgcctttcagaggacagcttagcaagataacaaaattatgttctctccttttaaggattacagaggcatagcctcagcgacgcgcgtgctagcggatccagttatcatcatcgtgttgggcttcctgggcctggcctgcctagcaggcctgtcgacagcttcagaaggggaactcgttggcggattgtccacagtagcacgtactatatgcagaaaaagtccttatgtctctcttatcattagcctattaatcatattaattcagtccacataggaccgaatttataacttaacaatcttttagtttcctgagcaatatcgttaaatcaaaacatattcttgtaccaaattttgctatcaacggttcaacgcctagttagttagcggaccgaagcttcctgaattccaggtggagctcgaattcctgcagccctcgagggggggcccggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 42 - DNA, 19832 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcaattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagctcggtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgacagctcgccaaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaagagatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttgtataataaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 43 - DNA, 7996 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatcgatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggtcacctttgtccaccaagatggaactgcggccgctcattaattaagtcaggcgcgcctctagttgaagacacgttcatgtcttcatcgtaagaagacactcagtagtcttcggccactggcgaaagggggatgtgctgcaaggcgattaagttgggtaacgccagggttttcccagtcacgacgttgtaaaacgacggccagtgccaagctcagatcagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgaccgccggggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctccgcgccgccggctacaagcacggcggctggcacgacgtcggcttctggcagcgcgacttcgagctgccggccccgccgcgcccggtgcgcccggtgacgcagatggatccaacaatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaggccgccaccgcggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccgctcattaattaagtcaggcgcgcctctagttgaagacacgttcatgtcttcatcgtaagaagacactcagtagtcttcggccagaatggcctaactcaaggccatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgccac

SEQ ID NO: 44 - DNA, 10856 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 45 - DNA, 1680 bp, Oryza sativa
atggcctccatcaccaactggctcggcttctcctcctcctccttctccggcgccggcgccgaccccgtcctgccccacccgccgctgcaagagtgggggagcgcttatgagggcggcggcacggtggcggccgccggcggggaggagacggcggcgccgaagctggaggacttcctcggcatgcaggtgcagcaggagacggccgccgcggcggcggggcacggccgtggaggcagctcgtcggtcgttgggctgtccatgatcaagaactggctacgcagccagccgccgcccgcggtggttgggggagaagacgctatgatggcgctcgcggtgtcgacgtcggcgtcgccgccggtggacgcgacggtgccggcctgcatttcgccggatgggatggggtcgaaggcggccgacggcggcggcgcggccgaggcggcggcggcggcggcggcgcagaggatgaaggcggccatggacacgttcgggcagcggacgtccatctaccggggtgtcaccaagcacaggtggacaggaaggtatgaagcccatctttgggataacagctgcagaagagaaggtcagactcgcaaaggcagacaagtcaatgcaggaggatatgataaggaagaaaaagctgctagggcttatgatttggctgcccttaaatactggggcactacaacgacgacgaattttccggtaagcaactacgaaaaagagttggatgaaatgaagcacatgaataggcaggaatttgttgcatcccttagaagaaaaagcagtggattttcacgtggtgcttccatatatcgtggtgttacaagacaccatcagcatggaaggtggcaagcaaggataggacgggtggcaggaaacaaggatctgtatttgggcacatttggcacccaagaggaagctgcagaggcatatgatatcgctgcaatcaaattccgtggtctcaatgctgtgacaaactttgacatgagccggtacgatgtcaagagcatcattgaaagcagcaatctcccaattggtactggaaccacccggcgattgaaggactcctctgatcacactgataatgtcatggacatcaatgtcaataccgaacccaataatgtggtatcatcccacttcaccaatggggttggcaactatggttcgcagcattatggttacaatggatggtcgccaattagcatgcagccgatcccctcgcagtacgccaacggccagcccagggcatggttgaaacaagagcaggacagctctgtggttacagcggcgcagaacctgcacaatctacatcattttagttccttgggctacacccacaacttcttccagcaatctgatgttccagacgtcacaggtttcgttgatgcgccttcgaggtccagtgactcatactccttcaggtacaatggaacaaatggctttcatggtctcccgggtggaatcagctatgctatgccggttgcgacagcggtggaccaaggtcagggcatccatggctatggagaagatggtgtggcaggcattgacaccacacatgacctgtatggcagccgtaatgtgtactacctttccgagggttcgcttcttgccgatgtcgaaaaagaaggcgactatggccaatctgtggggggcaacagctgggttttgccgacaccgtag

SEQ ID NO: 46 - protein, 559 aa, Oryza sativa
MASITNWLGFSSSSFSGAGADPVLPHPPLQEWGSAYEGGGTVAAAGGEETAAPKLEDFLGMQVQQETAAAAAGHGRGGSSSVVGLSMIKNWLRSQPPPAVVGGEDAMMALAVSTSASPPVDATVPACISPDGMGSKAADGGGAAEAAAAAAAQRMKAAMDTFGQRTSIYRGVTKHRWTGRYEAHLWDNSCRREGQTRKGRQVNAGGYDKEEKAARAYDLAALKYWGTTTTTNFPVSNYEKELDEMKHMNRQEFVASLRRKSSGFSRGASIYRGVTRHHQHGRWQARIGRVAGNKDLYLGTFGTQEEAAEAYDIAAIKFRGLNAVTNFDMSRYDVKSIIESSNLPIGTGTTRRLKDSSDHTDNVMDINVNTEPNNVVSSHFTNGVGNYGSQHYGYNGWSPISMQPIPSQYANGQPRAWLKQEQDSSVVTAAQNLHNLHHFSSLGYTHNFFQQSDVPDVTGFVDAPSRSSDSYSFRYNGTNGFHGLPGGISYAMPVATAVDQGQGIHGYGEDGVAGIDTTHDLYGSRNVYYLSEGSLLADVEKEGDYGQSVGGNSWVLPTP

SEQ ID NO: 47 - DNA, 2104 bp, Oryza sativa
atggcttctgcaaacaactggctgggcttctcgctctccggccaagagaatccgcagcctcaccaggatagctcgcctccggcagccatcgacgtctccggcgccggcgacttctatggcctgccgacgtcgcagccgacggcggccgacgcgcacctcggcgtggcggggcatcatcacaacgcctcgtatggcatcatggaggccttcaataggggagctcaagaggcacaagattggaacatgagggggctggactacaacggcggcgcctcggagctgtcgatgctcgtcggctccagcggcggcaagagggcggcggcggtggaggagaccgagccgaagctggaggacttcctcggcggcaactcgttcgtctccgagcaagatcatcacgcggcggggggcttcctcttctccggcgtcccgatggccagcagcaccaacagcaacagcgggagcaacactatggagctctccatgatcaagacctggctccggaacaacggccaggtgcccgccggccaccagccgcagcagcagcagccggcggccgcggccgccgccgcgcagcagcaggcgcacgaggcggcggagatgagcaccgacgcgagcgcgagcagcttcgggtgctcctccgacgcgatggggaggagtaacaacggcggcgcggtctcggcggcggccggcgggacgagctcgcagagcctggcgctctcgatgagcacgggctcgcactcgcacctgcctatcgtcgtcgccggcggcgggaacgccagcggcggagcggccgagagcacatcgtcggagaacaagcgggccagcggcgccatggattcgccgggcggtggcgcgatagaggccgtgccgaggaagtccatcgacacgttcgggcaaaggacctcgatatatcgaggtgtaacaaggcatagatggacagggcgatatgaggctcatctctgggataatagctgtagaagagaagggcagagtcgcaagggtaggcaaggtggctatgacaaggaggataaagcagcgagagcttatgatttggcagctctgaagtattggggcacaacaacaacaacaaatttcccaataagtaactatgaaaaagagctagatgaaatgaaacatatgaccaggcaggagtatattgcatacctaagaaggaatagcagtggattttctcgtggtgcatcgaaatatcgtggtgtaaccaggcaccatcagcatgggagatggcaagcaaggatagggagggttgcaggaaacaaggacctctacttaggcaccttcagcaccgaggaggaggcggcggaggcgtacgacatcgcggcgatcaagttccgggggctcaacgccgtcaccaactttgacatgagccgctacgacgtcaagagcatcctggagagcagcacgctgccggtgggcggcgcggcgaggcggctgaaggaggcggcggaccacgcggaggcggccggcgccaccatctggcgcgccgccgacatggacggcgccggcgtcatctccggcctggccgacgtcgggatgggcgcctacgccgcctcgtaccaccaccaccaccaccacggctggccgaccatcgcgttccagcagccgccgccgctcgccgtgcactacccgtacggccaggcgccggcggcgccgtcgcgcgggtggtgcaagcccgagcaggacgccgccgtcgctgccgccgcgcacagcctccaggacctccagcagctgcacctcggcagcgccgccgcccacaacttcttccaggcgtcgtcgagctcgacggtctacaacggcggcggcggcgggtaccagggcctcggtggcaacgccttcttgatgccggcgagcaccgtcgtggccgaccaggggcacagcagcacggccaccaaccatggaaacacctgcagctacggcaacgaggagcaggggaagctcatcgggtacgacgccatggcgatggcgagcggcgccgccggcggcgggtaccagctgtcgcagggctcggcgtcgacggtgagcatcgcgagggcgaacggctactcggccaactggagctcgcctttcaatggcgccatgggatgat

SEQ ID NO: 48 - protein, 700 aa, Oryza sativa
MASANNWLGFSLSGQENPQPHQDSSPPAAIDVSGAGDFYGLPTSQPTAADAHLGVAGHHHNASYGIMEAFNRGAQEAQDWNMRGLDYNGGASELSMLVGSSGGKRAAAVEETEPKLEDFLGGNSFVSEQDHHAAGGFLFSGVPMASSTNSNSGSNTMELSMIKTWLRNNGQVPAGHQPQQQQPAAAAAAAQQQAHEAAEMSTDASASSFGCSSDAMGRSNNGGAVSAAAGGTSSQSLALSMSTGSHSHLPIVVAGGGNASGGAAESTSSENKRASGAMDSPGGGAIEAVPRKSIDTFGQRTSIYRGVTRHRWTGRYEAHLWDNSCRREGQSRKGRQGGYDKEDKAARAYDLAALKYWGTTTTTNFPISNYEKELDEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKSILESSTLPVGGAARRLKEAADHAEAAGATIWRAADMDGAGVISGLADVGMGAYAASYHHHHHHGWPTIAFQQPPPLAVHYPYGQAPAAPSRGWCKPEQDAAVAAAAHSLQDLQQLHLGSAAAHNFFQASSSSTVYNGGGGGYQGLGGNAFLMPASTVVADQGHSSTATNHGNTCSYGNEEQGKLIGYDAMAMASGAAGGGYQLSQGSASTVSIARANGYSANWSSPFNGAMG

SEQ ID NO: 49 - DNA, 1977 bp, Oryza sativa
atggcttctgcagataactggctaggcttctcgctctccggccaaggcaacccacagcatcaccagaacggctcgccgtctgccgccggcgacgccgccatcgacatctccggctcaggcgacttctatggtctgccaacgccggacgcacaccacatcggcatggcgggcgaagacgcgccctatggcgtcatggatgctttcaacagaggcacccatgaaacccaagattgggcgatgaggggtttggactacggcggcggctcctccgacctctcgatgctcgtcggctcgagcggcggcgggaggaggacggtggccggcgacggcgtcggcgaggcgccgaagctggagaacttcctcgacggcaactcattctccgacgtgcacggccaagccgccggcgggtacctctactccggaagcgctgtcggcggcgccggtggttacagtaacggcggatgcggcggcggaaccatagagctgtccatgatcaagacgtggctccggagcaaccagtcgcagcagcagccatcgccgccgcagcacgctgatcagggcatgagcaccgacgccagcgcgagcagctacgcgtgctccgacgtgctggtggggagctgcggcggcggcggcgccgggggcacggcgagctcgcatgggcagggcctggcgctgtcgatgagcacggggtcggtggccgccgccggagggggcggcgccgtcgtcgcggccgagagctcgtcgtcggagaacaagcgggtggattcgccgggcggcgccgtggacggcgccgtcccgaggaaatccatcgacaccttcgggcaaaggacgtctatataccgaggtgtaacaaggcatagatggacaggaagatatgaagctcatctgtgggataatagctgtaggagagaaggccaaagtcgcaaggggagacaggtttgtgtaggcggttatgacaaagaagataaggcggctcgggcttatgatttggcagctctaaaatactggggcacgaccacaacaacaaatttcccaatgagtaattatgaaaaggagctagaggaaatgaaacacatgaccaggcaggagtacattgcacatcttagaaggaatagcagtggattttctcgtggtgcatccaaatatcgtggtgttactaggcatcatcagcatgggagatggcaggcaaggatagggcgagttgcaggcaacaaggatatctacctaggcaccttcagcaccgaggaggaggccgccgaggcgtacgacatcgccgccatcaagttccgcgggctcaacgccgtcaccaacttcgacatgagccggtacgacgtcaagagcatcctggacagcagcacgctgccggtcggcggcgcggcgcggcggctcaaggaggcggaggtcgccgccgccgccgcgggcggcggcgtgatcgtctcccacctggccgacggcggtgtgggtgggtactactacgggtgcggcccgaccatcgcgttcggcggcggcggccagcagccggcgccgctcgccgtgcactacccgtcgtacggccaggccagcgggtggtgcaagccggagcaggacgcggtgatcgcggccgggcactgcgcgacggacctccagcacctgcacctcgggagcggcggcgccgccgccacccacaacttcttccagcagccggcgtcaagctcggccgtctacggcaacggcggcggcggcggcggcaacgcgttcatgatgccgatgggcgccgtggtggccgccgccgatcacggcgggcagagcagcgcctacggcggtggcgacgagagcgggaggctcgtcgtggggtacgacggcgtcgtcgacccgtacgcggccatgagaagcgcgtacgagctctcgcagggctcgtcgtcgtcgtcggtgagcgtcgcgaaggcggcgaacgggtacccggacaactggagctcgccgttcaacggcatgggatga

SEQ ID NO: 50 - protein, 658 aa, Oryza sativa
MASADNWLGFSLSGQGNPQHHQNGSPSAAGDAAIDISGSGDFYGLPTPDAHHIGMAGEDAPYGVMDAFNRGTHETQDWAMRGLDYGGGSSDLSMLVGSSGGGRRTVAGDGVGEAPKLENFLDGNSFSDVHGQAAGGYLYSGSAVGGAGGYSNGGCGGGTIELSMIKTWLRSNQSQQQPSPPQHADQGMSTDASASSYACSDVLVGSCGGGGAGGTASSHGQGLALSMSTGSVAAAGGGGAVVAAESSSSENKRVDSPGGAVDGAVPRKSIDTFGQRTSIYRGVTRHRWTGRYEAHLWDNSCRREGQSRKGRQVYLGGYDKEDKAARAYDLAALKYWGTTTTTNFPMSNYEKELEEMKHMTRQEYIAHLRRNSSGFSRGASKYRGVTRHHQHGRWQARIGRVAGNKDIYLGTFSTEEEAAEAYDIAAIKFRGLNAVTNFDMSRYDVKSILDSSTLPVGGAARRLKEAEVAAAAAGGGVIVSHLADGGVGGYYYGCGPTIAFGGGGQQPAPLAVHYPSYGQASGWCKPEQDAVIAAGHCATDLQHLHLGSGGAAATHNFFQQPASSSAVYGNGGGGGGNAFMMPMGAVVAAADHGGQSSAYGGGDESGRLVVGYDGVVDPYAAMRSAYELSQGSSSSSVSVAKAANGYPDNWSSPFNGMG

SEQ ID NO: 51 - DNA, 2082 bp, Sorghum bicolor
atggcttcgacgaacaaccactggctgggtttctcgctctcgggccaggataacccgcagcctaatcatcaggacagctcgcctgccgccgccggcatcgacatctccggcgccagcgacttctatggcttgcccacgcagcagggctccgacgggaatctcggcgtgccgggcctgcgggacgatcacgcttcttatggcatcatggaggccttcaacagggttcctcaagaaacccaagattggaacatgaggggattggactacaacggcggtggctcggaactctcgatgcttgtggggtccagcggcggcggcgggggcggcggcaagagggccgtggaagacagcgagcccaagctcgaagatttcctcggcggcaactcgttcgtctccgagcatgatcagtccggcggttacctgttctctggagtcccgatggccagcagcaccaacagcaacagcgggagcaacaccatggagctctccatgatcaagacctggctccggaacaaccaggtgccccagccgcagccgccagcagctccgcatcaggcgccgcagactgaggagatgagcaccgacgccaacgccagcgccagcagctttggctgctcggattcgatggggaggaacggcacggtggcggctgctgggagctcccagagcctggcgctctcgatgagcacgggctcgcacctgccgatggttgtggccggcggcggcgccagcggagcggcctcggagagcacgtcatcggagaacaagcgagcgagcggcgccatggattcgcccggcagcgcggtagaagccgtcccgaggaagtccatcgacacgttcgggcaaaggacctctatatatcgaggtgtaacaagacatagatggacagggcgatatgaggctcatctatgggataatagttgtagaagagaagggcagagtcgcaagggtaggcaagtttaccttggtggctatgacaaggaagacaaggcagcaagggcttatgatttggcagctctcaagtattggggcactactacaacaacaaatttccctataagcaactatgaaaaggagctagaggaaatgaaacatatgactaggcaggagtatattgcatacctaagaagaaatagcagtggattttctcgtggcgcatcaaaatatcgtggagtaactagacatcatcagcatgggagatggcaagcaaggatagggagagttgcaggaaacaaggatctctacttgggcacattcagcaccgaggaggaggcggcggaggcctacgacatcgccgcgatcaagttccgcggtctgaacgccgtcaccaacttcgacatgagccgctacgacgtcaagagcatcctcgagagcagcacgctgcctgtcggcggcgcggccaggcgcctcaaggatgccgtggaccacgtggaggccggcgccaccatctggcgcgccgacatggacggcggcgtgatctcccagctcgccgaagccgggatgggcggctacgcctcgtacgggcaccacgcctggccgaccatcgcgttccagcagccgtcgccgctctccgtccactacccgtacgggcagccgccgtcccgcgggtggtgcaagcccgagcaggacgcggccgtcgccgccgccgcgcacagcctgcaggacctccagcagctgcacctcggcagcgcggcacacaacttcttccaggcgtcgtcgagctcggcagtctacaacagcggcggcggcggcgctagcggcgggtaccaccagggcctcggtggcggcagcagctccttcctcatgccgtcgagcactgtcgtggcgggggccgaccaggggcacagcagcagcacggccaaccaggggagcacgtgcagctacggggacgatcaccaggaagggaagctcatcgggtacgacgccatggtggcggcgaccgcagccggcggggacccgtacgccgcggcgaggagcgggtaccagttctcgtcgcagggctcgggatccacggtgagcatcgcgagggcgaacgggtactctaacaactggagctctcctttcaacggcggcatggggtga

SEQ ID NO: 52 - protein, 693 aa, Sorghum bicolor
MASTNNHWLGFSLSGQDNPQPNHQDSSPAAAGIDISGASDFYGLPTQQGSDGNLGVPGLRDDHASYGIMEAFNRVPQETQDWNMRGLDYNGGGSELSMLVGSSGGGGGGGKRAVEDSEPKLEDFLGGNSFVSEHDQSGGYLFSGVPMASSTNSNSGSNTMELSMIKTWLRNNQVPQPQPPAAPHQAPQTEEMSTDANASASSFGCSDSMGRNGTVAAAGSSQSLALSMSTGSHLPMVVAGGGASGAASESTSSENKRASGAMDSPGSAVEAVPRKSIDTFGQRTSIYRGVTRHRWTGRYEAHLWDNSCRREGQSRKGRQVYLGGYDKEDKAARAYDLAALKYWGTTTTTNFPISNYEKELEEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKSILESSTLPVGGAARRLKDAVDHVEAGATIWRADMDGGVISQLAEAGMGGYASYGHHAWPTIAFQQPSPLSVHYPYGQPPSRGWCKPEQDAAVAAAAHSLQDLQQLHLGSAAHNFFQASSSSAVYNSGGGGASGGYHQGLGGGSSSFLMPSSTVVAGADQGHSSSTANQGSTCSYGDDHQEGKLIGYDAMVAATAAGGDPYAAARSGYQFSSQGSGSTVSIARANGYSNNWSSPFNGGMG

SEQ ID NO: 53 - DNA, 11086 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 54 - DNA, 9765 bp, Artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatcctgaggatatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcaattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccattgggtcatcggatcccgggcaactttattatacaaagttgatagatatctggtctaactaactagtcctaaggacccggcggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccaccggtcgccaccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgaagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagcttaagccatggcccgggaatcttagcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 55 - DNA, 1357 bp, Zea mays
ttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatatataggctctattattattattattaattaaactcgctctaaggaggaaagtgggaggaagggacgaggacgaagactactggaagcatcgtccatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatatatactgtacatgcctccctccaacacccaaccacctcctgctcggctcttaataacttggacacggatcgatgccatccaaggaagaagacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccttggacacggatcgatgccatccaaggaagaagacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaac

SEQ ID NO: 56 - DNA, 10088 bp, Zea mays
actttggctaaggttagtcgtttgaattgaataactaaccttagacagaaaagttaggcaaagtgtgacaatttaggtagcaaaccaaacaacccatcagtactcccgcttcacacattatgtgggcaagatcagataagcaatatacacttttctttggatgtcttcaattcgatatatttaaggaactcctaaattatatttatggatgcagaacttttattgcaaacatttgtgacttttatgtacctaacatttttctatttctggtgggactgttgatgcatctcttcactgtgagatccaaactgagagtgtgtttgatttctaggactaatttttagtccattcattttattccattttagtccttaaattgccaaatatagaaacttgtattggcaatttaggaactaaaataaaataaaatggagtgactgaattagtcctaaaaaccaaacaccccttgaattggttgaggtagtaggcatttagtaggtgctaagttctttgagcttggtcgaacgctgatgatgcttcacactgtatacataatttgtttttctttccttcatgctatgtaactaactttgtacatgtcaccatagtgaaatcttttaattccgcagtctagggcttatgtaaattctaggcctgctgtttatattaactccacgagaccagacccaatcatggttgaggtgattattgctacacatttttcatgttacttttgatggcctagagcgctacaataatctaatcaacaaatttcctttgtgcaaccatcttttcaaagcacccctccttttggtgtctctaatatagtagctctaggtgaaatttctggtgcttttggtattaatggtccttctcgacatgtgaatgtgccaagtaacagtaaggtcacatttgaatgcttattaactattggttccctcttgttagggtcatgaaccggaaaagcgaccacgagatactgccatttcaaccctgttggtacttaagctattcggttcaatggttcaaggaacacatgccaatagtgatcttgaaatttgaaatagaggcttactatggtttatttaacctgaagaattggggatgtattgtttgattgcttatgcattatacaatttgttgtaacacacaaattttgccttggttttaataggtccgataaatgcatagaagcttatccaacccaaaggacaaaataccaaggtattaatgtcatggtctctcgtccctcgacgagaaattcacgaagcaagaaataaaaaaaatcaattggtctcatgccaggggacaaagctccagggccagatgccttcactggcaccttcatcaaaacttgctgggacatcataaaaacaaatgttgtggcagttgccaatgctttccatgtcctgcggtgcactaatttgcaaatcgtcaacttcgcaaaaatagtcttcataccaaagaaagaaggagcacatactgtggcaaattttaggccaatatgttaaatccactcttttattaatatcatcatgaagactctagcacttcgtataacccctcgcatgaatgagattgtctcgcctggctaaagtgccttgatcaagacaaggagtatccatgacaactacatggcagtacatagcatgatctagatatgtaatagaaacaaaactctcaccctcttcctatagctcgacattgctaaagcatttgactctgtcagatgggacttccttcaattcttgagctattgcaacgtcttgggttcccaacacgttggcgtgatcgggttgcgacaattatctctccatcaacgtcacgggtgttcgtcaacggggtcccaaaccctcctctttggcatggaagaggtcttcggcagggtgaactgctctccccctcctcttcatcattgctattgatcctctataattacttcttcagaaggcgactgagttgagcatatgaagtaaaattcggggacgctgaccaaatctgcgcatttccctctacgcagatgactcagcattattcatcaaaccaaataaggaggagatgaaggggactgtgcaacttctaaatttttttggccatgccttgggtctcatcacaaatttccataaatcaactgtggtcgtaatttgctgcgatggcatagacctagctagcgttctggaggggctaccggccaaaaggacaatgttttcgatcagatttattggcctacctttatccaactccagactccgtaaggtggactttcagttcttgctagacaaagtcttgagtatacttaatagctggaacgaaagaaatttgaacatggcgagacgcctgccttggtcaagttagtgattacatctcaaactatctacctcctatctgccctcaaagcaccaaatgaaattatggagttcgtggactcaaagcggaggcaattattttgagctggaatggagagagtcacgagagggaaatgcaaagtgaactggacctgttcagcaagaccaaaagccctaggaggtttgggcatcctacacctgcaatcttttgcatgagcgttgtgcttgaggtggttatggtaggattggacaaccattatttgtcctagcctcgggatcgactcgccttgcatgaaaattgacaggctgctctttgcagcagtgactagcttgacggtgggggatggcagtcgcgtttcattctacgatagtgcgtggatgcagggaatgttagtttgacaaacaatttgtttgaatagtagtcatgtaaacattgctattattaatgtcttcttttttctttagaatccaaaccagttacacgacttcgtcgacgagttgttcgcttctggaggtagtggtcacaactccaatgaccccgatatgtgacggtttgagttttgtgtcgaattgtgagtttgttttatgttgtaatgtactatgtgatgtatttgtgaactgtgatgtggtaaaccatttgtgaactgtgaacttgattttggtgaacttcaatgtggttgtgaagaagtgtgatactttgtgttaaatgtgtgtaattctggaattaatgtttctgtcattttattgtgattatattgttgctgaaattgttgttttttgcatttatttcaaatttttttctctgaaattgttacttttcggcggccaacagaggccgccaaaaataataatggcacattttcagcggccactattttcggcggctagatgccagccgccgaaaataagtgtttattttcggcggccaatgagcctgaaactggccgctggaaataatggcttattttcggctaattttttctggtggccagaaatcaccgaaaataggcctaaagccaccgaaataagctacttttggtggcgaatgcctcattttcggcggcctcggctgtagctgtcgtagtgaacaatgcgaagagacatcgccccaaacatgttctgaatttccaagaaaaaatagatcattgcatgatgccttatgcaataataattggattcgggacatcaatctgcaacatcatgatttctcaagcatatatggacaagagtgaaacaggtacagctgcggtcagaagcaaacctgacagtatatcttgaagctttctagaaacaaccagtacacaatgagatcaacatacctagcacaatttttggggtccatacatactaacctggaatggatcgtctggaagaactaggctccaccaaagtgtaagttttttcagctcgctagcgatccaggataggatttggatggccggccatttggcaaggaggggatggccacataacctggtgtgcgccctctgtcacatctttcaagaaaatggtctgcatctcttctctgattgccgttcctgttaggcgcatttgggcagaggttgaatgctgggcgacaattgaagatttaggcccggtttgggaacaaagtttttgaaaaacacagtttttgaaatactacagtatactttagtcatgacaatactgcagtttacaataccacaattttggaaactgaggtccagacctaagtttagaataccttaaaacaactatagtatttgtaatacttcagttttaaaaacagagattttagccagcttgtcaaacaccattctgtatataatactgcagtatttgagaatactgcagtattcttccaaaactgtgaaaaaacttcactcccaaacacgccccttatctcctaactcttggggccaacacgattcagtcctccaatggtggacgttaagatccaaagcctcaatgagaaatagaagcgacctgaggagcttgattatgctagttacttgggagctttggtgtgagaggaatacgagaatctgggacggcaaggagtcatcagtgtagaaatcagaggcgcgatggaaataggtggaacgtcggtctccgctccagagatcacgacggcttcgtgtttgatatttctggtggcacaaaaacaaggcgcgagttacatatatatagatgagtatggccagctttagatctattctaggaaaggataagttttacatggttacaattgatctatttctattaactgcctatagatcttagccgacaatatctcaaccatatttggaatacaacacatatatgttaacactccccctcaatctaaatcttctccaagttgagattgcctttgaacaattccaactgtcgcgccgccagtggttttgtaaacccatcagccacctgatctcttgttgacacatgttctatttcaagtaattgccttgcaactctttctcgaacaaaatgataatcaacttcaatatgttttgtacgtgcgtgaaataccggatttgccgaaagatatttagcccctatattgtcgcaccatagctttgcctttcttggtgcttgaatcccaatttctaacagtaaaatctgaatccacatgatctctgcagttgcatttgccaacgccttgtactctgcttctgtgctagaccttgacactgttgcttgttttcttgctttccaggaaacaagatttgatcctagaaaaattgcaaaccctcctgtggagcgcctatcatcaagacttccagcccaatctgcatcactgaaaccactaactagaagtgacgttgttttaccaatctttaagccaagccttgttgtgtgctttagatatctcaagattcttttgactgcagcccaatgaacagtagtaggtgcgtgcaaaaactgacatactttattaacagcaaaagagatatcaggccttgttaaagtcaagtactgcaatgcaccaaccatgcttctatactgagtagcatcatttggaccgagtagatctccttcatggaccgaaagcttctctgaagtagacataggagtagcgactggtttacaatcactcattccaattctttttaatacatctgaggcatacttttcttgcgtcaaaatcagaccatcggataccttatttacctcaattccaagaaaataatgcagatcacctagatcttttagagcaaactctttgttaagatcactgagcaaagctgaagttgcacttggtgttgaactagccacaatgatgtcatcaacataaacaagtacatacatactgatgttacctttattataaaagaacagagatgtgtctgccttagatgatttgaaacccaagtcttgtaacttcatactaagtctggaataccacgctcttggcgcttgtttgagtccatataaagccttgtcgagcctgcacacataacttggcaaagatttgtcctcatacccaggtggttgcttcatataaacttcctcttctagtaaaccatgtaaaaaggcattttgaacatctagttgacgaagactccaacctcttgacacggcaacagaaagaataactctaattgtcgctgccttaatcacaggactgaaagtatcttcatagtctatcccatacctttgcttgaagcctttagcaacaagacgagccttgtacctgtcaagacttccatctgcctttctctttatcttatacacccatttacagtcaataatattagtgcccttttttggaggtacaagatgccaggtcttatttttcatcaaagcagagtattctagatccatagcatctttccaattcttatcttctaaagcttcatttatattatgtggttcccctgatgatgtaaaacacccatatctaatagtgccatcagtatatacctttggtttgcgaattccagcttgtagacgtgtccttggccttgaatcttcaggtgcagtaggctgtacaatttgggacgcagctccctcggccataggcgatcccggtgctggcggtggcaaatcctctgtggaatcggcgccgatcgggtcataggaatcaggcgcatgagattctgtctgctgcccaagctcggtcggcgacgtagcttgatttggttgatcagcgatgctggacgggagagcggacacacgtgctggcgacgcggtttctgcacacacttcatcacatagattattagaatcaaacctgtgatcacccattagttctcccccttgatcagatggtattggctggagatcagatggaaggagagaaatttcctgacgaagtcgagctcctgcatttggatgaagttgtgagaaaggaaagacattctcatcaaaggcgacgtcccgagatatgtagacccggcctgtggaaggatctaagcacttaaagcctttgtgcgagggactatagccaagaaacacacactgcttagagcgaaactgaaatttatgtgtgttgtagggacgtagatgtggccaacatgcacaaccaaacactctaagagaagaatagtctggtttttgctgaaacagacgttcaaggggcgtgtcataatttatgactcgactaggagttcgattaatcaaataagtggcagctacaaaagcatcttcccaatatttaagagggattgaggcgtgagcaaggagagctaaaccgacctcaataatatgcctatgttttcgttctgcagccccgttttgttgatgagcgtgaggacatgatacaaggtgagatatcccgacacgctcaaaaaaggagtgaagcttctgatattcacctccccaatcagtttgtatggcaataattttttgattaaatagtctctcgacaaggttttgaaattcattgaatttctgaaaaacttcagatttatgcttgataagataaatccacacatatttgctgtaatcatcgataaagctaacataatatttgttctttccaaccgaattaggtggaggaccccaaacatctgaaaacacaagctccaaaggtttactagaaacactatgtgacttgggatagggaagctgatgactctttgccttttgacaggcatcacacaccgactctttatttgattcatctaaacaaggaagattatttgtgctaataactttagaaacaatgggggcagaagcatgacccaaacgactgtgccatctttcgaaagatggtttgacaactccaaaggcttgctttatggcgggtagaggaagagggtaaagacccttgcggcatggccccttaaggatggtgttcttcgttgcctgatccttgatcaaaaaataatcaggatgaaattcaaggaaagcagaattatctttggtgaggcgatgaactgaaacaagatttttagtggcctttggaacatgaagaatattgtttagatgtaaattgcgagttggggtgtgaactaatgaatgaccaatatgtttgatttccatacctgcgccgcttgctgtatgaatctggtcacttccatgatacttgtcacgaacggcgagcttctcaagatcactagtgatattgtctgtagcaccagagtccatgtaccagttttgatccatagaataagggctcattgcagcagcaacatggcgttcctctggaacatagttttcatcaaacctgtgccaacagtcaatcgccgtgtgtcccgtcttgaagcagacctgacagattgggcgcccattgttgtcgtgggttgcagttgggcccgtggggaagctcctgcgttgctggttttgccgtagtggctgctgctgcccacggccacggccaccagagctacggccggagttctgccgtccacctcggccacgatttgggccacgcatttgctggctcccaccacggccgccgcctcttcctgctgaattcgctgatgacgatgacccgatgccaagctgtaactctaatctagtctcaaagctcaaaagttgggagtacaattctgaaggagtaacaggttctagtctagttacaagagcagaaactagaggattgtactcaagatcaagaccgttgcagatatacatcaccagttcctcatcgtcaaggggtcttcctgctgcagccatctcgtctgcaagccccttcatcttgccatagtattgggcaacagtcatgttgtccttcttcgtcgtggcgagggcaagacgcacattagtagcacgtgcacgcgtgtgagaggcgaacatgtcggtgatgatcttccatgcttcagcggcggttcttgcaatggcgacttgtgccaagatatccctggacagggaggtgagaagaaatcctaggacttgttggtccgtggcgaaccattcgtcgtaggctggattggaaaccttagcgatcttgccgtcgctctgcttctcatcaatttcttcagatggagcgacggctttgccgttgacataccgctccagtcttgcgcctcgtaagatcgcaagaacttgcgccgaccacataccgtgattctggcgagtgagtttctctgtgacttgaacaccaaggagaggattcgatgacgagtttgaggacgccattgctaggatgattaaccctaggctctggtaccatgtagaaatcagaggcgcgatggaaataggtggaacgtcggtctccgctccagagatcacgacggcttcgtgtttgatatttctggtggcacaaaaacaaggcgcgagttacatatatatagatgagtatggccagctttagatctattctaggaaaggataagttttacatggttacaattgatctatttctattaactgcctatagatcttagccggcaatatctcaaccatatttggaatacaacacatatatgttaacaatcagtctagcagctaggttgctgtgtggattcgtgaagcggcaaattcttggatggctgcaggtgcccgacatctttcgagcctccttgcaaattgctagtttttttcttgtttttcctctttgacttggtccgagtgtgctatgcagttgctgtgagagtgcaccttctgcttagtcgcatgatacaaggaactgttgattctaaaaaaaactttattttaatgtaaaggagagagaatttaatatcagttttttttcgatatagactttcatgtgattttgcatcgcccgatacatcagtgtgtttgtttggctttagtccatagcggcttctataacgttttgcctcgatagattacagctagctgcagcagttttaaaagccgtctttaatcggaagccaacatctcgacatatagagcgttcgataggatgcttacttattctagtctattaaatttcccaccgctgctaattaatgctaatgaattaactctctctgcctatccctcgacatgcactaatgtaggagtatatcccaacgcccaaccacctcctaataacttcgacggatggcagctaccgtccatggaagatggtgacggaatgtccagcattccaccgactgccagaaactgcacgcacatctgtcatcagcaatcgctagcctatttaatgagcaacattccattgcaatctcctcaggccacttacctgcagtcaccactcccaagccagtacccacagtcctacgagcagtcgcacgcaagtgtcaagagacgaaacggtcgacgccacttacctgcagtcaccactcccaagccagtacccacagtcctacgagcagtcgcacgcaagtgtcaagagacgaaacggtcgac

SEQ ID NO: 57 - DNA, 1860 bp, Sorghum bicolor
taagtgaaaggaaccatcaaatgtgtagccaacaaagtatcaacaaattctacactagatctcatacaaacaagggcaaccacaatgtactatgatctgtagtacaaacattgacctcaacttagatttaacgatccatgcagagatcaaactccacgttgcaccgaaatcctccaactcggactcgattgggagcttaatcttctcttcgccatacataattaagagtggtagaaatgagctacagttaagacatcattgaatagcagctgcaaggaattgaatcaaaccatccgaaacaccgcctcatacatctagaggaaagataaatgggagcccctctccgtcgggaccggatcagttcgagagtatatttgagttttagcccctttatataaaaaggtagaggttcatttagaagtttggttgaagttgctctatacgcatcaaccaatcttttcatacaagatctcatctctaaacattacacacgaatctatctgttactttctagaatataatcccaagttctttttagaacggatcgaggtagagcagtatttttctttgatggtcaaaagttgtttgtttttgaatctaaaattttaaaaaatttgtttgttttgaacaaaaattgagagatttgtttttgagggtcggacacatacgagttttgggaaaccgtcggtggtacctgcctgtgcacacagaggtagctagctaggttggggacgggatgcatgtatgtaatacgtggcggagcttccgatcgagacagcgacatgtgggctcccatacttgctggacaacttaatcgctaccactgctgcaacttcaatttgtgaatgtgcatgtaacctcctgcactgtactgatatctctgtttctggttgcggccgggaggaattaacgaagactactggaaggattcatggatgatggacgatccatatataattgacgtcttaatgcaggaagagtatgtgtttattgtgcgataagcactcggatccaactgcaaactacctcacactgacacactagtgagagagagtgaatacgcctccaacttcatcagatgagagccacgtacgtccgtccctgccgactgccgccatcaccctgcctgctaagtcgtgttaggcggctgctatttaagggcgtgtttaaatgtctttaaaattctaaatgtttataagatttctcgtcgcatcgaatctttagacgcatgtacgaaacataaaatatatataaataaaaaaaaaataattaactacatagtttgtatatgtaaatcgcgagataaagtacttgttgagtctagttagtctataattaaatatttattgctaaatataaacgaaagtgttatagtataacataccctaataagttgctattgctgctgcaaatgaattcactctgcctcgatcatgccctcatcaactaaccgctgtagtattatctgtatctatctgcctcctgctcccaacacccaaccacctcctgcccagcaattaacttcgacggatggcgacgataccgtccgtcgtccatggaagatgatgttggaacatccaccatattcattcattcatatgcatgcatccaccattccaccgactgcctgcctgaaactgcatgcaatgcaacaacaccgtgcatgcatgcacatctgtcatcagcaatgacaagctactgtagctagctcccagatcagatcagatcagatcgatcgcaagcctgcctatttaaggagccacactccatctcactctcctcaccagcggctagcacttgctcacttgcattccaaagctagtacaagcaagtctcagacacccccagaacatcgacgac

SEQ ID NO: 58 - DNA, 1856 bp, Sorghum bicolor
aacatatatctgcgaataaacgttgctggctagcttgatgacgtcgttataacatagacatgttttattgccgttttcctttagaaaaacaaacctaaaaatacaaagaaaatacgctagtttatttaggccatatcatctctgttttaactccgttttgtccattgaaattgtgttaggttcgtaatcacgagcactacatgttagtaatattgttcactcagtttgaaaccttttaatttcgtgaccttaattaattaattacttttctatataaaatcttagaaaatccatatcttttccgttttaactccgattttcgtcatctttacgtctgtgagatcgtagcgatgcgtagaattattttacaaatttttcatattgtttttatatgattggtgtactgttctaattatagccttgtttgctacgtgtatgttgtgtccgattgtttgtgtgttgatgatcgatgatcgagtttagacggagagcagtttcggtgatcaagatcaaagctttggcaacaagtgagaccagcaggaccaaaaggataagcaagagcaattggattgaggcaagtatagcatttggattttatttctgtgaccatgatcctgtgactagattaatgttaagtaataaatggtaaaaatgactttttaacaacttgatgatttgtctgtacgtgatcacccgggataacagtgcaaccatgagggctataatggctctggctttagctcagtatgaagaccttttctagcttgttagaggttacccgaaagggcggaggggctgaaccgacacgggtatagtgcgagcccctgtccctatgtgtataggctgcgcgtcattgtgccattcggaaggggggtatctatatctgctcgcaaaggaaaccttgcggccctaacatgttagacgaacttttgaaaggcttcatagtgatccctgccgaccttccttggaagtgggttaagaggctgatcacctcgggcgaaagggtaaatcatgactcatgggtaaagatgtgcaacctctgcagagtgttaaaactagtatactagccgagctcacggtcaggaacggccttggggacatctacattaagggtgatgaatcttgtgtgttaaatatgctcattgcttattgtttaatgctttacattatttatgtcacattgatcatgagattgtgggagctatacaatctagttgctatacttgtggagtttgacatggactcactcttgctatttcccccaaacctcaggagaagtttaggcttgtgatcaaccagtcagttggatcctgtagagagaagttaatacccggagtttggagttgtctatccgttgtttgctatcaaaggttatctcttttatattatgtacgttatataatttttgcattgtcttttgatattaccccttatttgtagctatatgtgagatttggcttttaaaactcacatatggtgcatatctggttttgtccttaaaatcgggtattacaacaactaaacaagcatctgccctcctccctcaacacccaaccacctcctccccagcagttaacttcgatgcatggcgagagataccatcgatccatggacatatacgcatatgcatgcatccaccgactgaaacagcatgcacacccatcccatgcatgcacatcactcatcagcaatcgctagctagctcacacatcgatcacaaagcctgcctatttaaggagcaacattccattgcaatctcctcaccagctagcacttgctcactcactgcatcccaaaagctatcagtcacctacgagcatcagcacatatatcacaggaggtcgatcgagatcgac

SEQ ID NO: 59 - DNA, 1588 bp, Setaria italica
tacgaagagagaggggcggagtttcattaagaatggctttatgtacaacacaatgataatggtctcataaacacatgatcatacgggtgaaacgacgacaaaattagtaaatctgtggaatgatcttatgcacaacaacagcaacatgaccttaatccaataatagtgccatctttatgtttgttctagaagagggccaagaggttggtggcacaggggaatgcatgtgccaagcagctatgactctccacggtgggacgccgacccacttgcaaagttgcaagccttgcgtgcccgctctagcaagtgtccgcgaataaaagttaagtaggccatgaatacatagtactcctacggtgtataggagaccgctatttgatgcactcgtaggtacacgtgtcacgattagcacttggcaggacattgatgcaggacacgtgtcacctatatgcgaaggtgtcctggaccttcacgactttttccttgatcccacgaagcgaaaccggaccttctctgctctgtccaaacatcatttcctaccatcacacttaagtaaacgtcgcggatctcctttgctctgtccaaacattatttcctacaatcacgcttaagtaaacgttgcttacctttggtgacggttcagcgagggtggcatttagtatcccgattcagatccccgacgcagtccgagaccgttcttctttttttttcttatggagcatgcagatacatgcatgtagatgcatggacttggacagatgtcaagtgtgtacgagttgcaccgcttccctcactcgtactcagcggcttgtacaagcatgtagcggtgtgtcgatccacaccacagtcgcgacgtccggcccatgcagttgtccatcgctagcagctcgatggctgcagctggagggtctgggtggacaaacgagtttcggcaaccgtcggtgcttcctgcttgtgcatctgtctgctgtcactatgctgggtaaattcatcacttaatcagtttaccaacggctaacctcctggaagagtacgtgtctttaatttgtttctggttgcagccatgcattaactattgtgggaagattacagctggaaggatcgatccgtgtaaacgaatggacggatggattggtatgatgtttaaacgtacaattatcatcgataagcactcgcatccaccccccaaaccctcgatcactgacactgaatgaattgaatgcgtgctgcctcaactgcacaccgaccatcatctgctggcccaactcccaactacctcctgccggtcccttaactcccatccggtcgatcgagaccgacaccaacgacagggatccaccgacgactgcaacacaccatgggcatggccatgcatgcacccatcagctagcagctccccgtctccgtcctcgtcagtcatcgctcacaaaccacacagagagctaggtcgatcgagaccctatttaaagaccaacattccctcctcaccagcaaagcaaagcacattcttcccaagcagcttgtagagcacatccgatccatcgaccacagcgcagctagcagctagcacaggaacacgcacatcagc

SEQ ID NO: 60 - DNA, 1798 bp, Oryza sativa
ggttggcaggtagatcgatacgagaatgacatgaacataatggatcgtcggcttcaatttggaagccacctgctggcgaccgacagccgtcccggccgggagggataacctacgtcaacgataaataaatactcctactaactggagtagctagcagcttggtcttgtgaaaaagaaagataaaattctactactccatagtgtacgtggtcttatctagagcttaattggattgcaaaatagcatacagctgattgattaaaaactacgttaaacttaggaggtgtttagaaattaggactaaatttagtccctctcacaaaaatataagtccctttagtccactttagtccctccaaccaaacaccaccttcaaacaccaccttagtaactgaaaattcttagatttaattgatcgatctgctgagagctttgcattgtggagcacatgccaggccagctagtacattcttgtgataagaaacatgaagtttcggtttaacctcttaaatacatgcatgcatggttgatacaatacacgtcctgaacatgaataaatactattaaatacgttatccgaattttatcatatagtaatatatttggattagtttcttaatatgacttttattcttttatcccaattatatatcaatctcttgtgtactaaaatgtgatgtgctattgagatatttcactgtgtttgtaccaactcctgaaaatactcatcatatcgtcgttgttggttggcattcatagtttattttgtagcagctgagcaattttaattagtctttttagcttgtaagattcttatatttcttagcaatagccgagcgcattattgggctatagtgtaaccaggtgaagcgtacgcgtgtgcataagttgtccttgtggttgaaagaagaatactggaaggatcgttggatgttactgctgatatgatggacacttggatccaaacatcatgaatgcgctcaactacttgcatgttccaaatgtacaacatgcatgctagctgctacaaacgactagctccgttaggccgctgctaatcattttctcatcactaatactaacactgtgtgactagctagctaaaccagccctaacaaccaaccaccctgattcaattgaattgaattgaataacattagacgcaccgacgactaagaacggtgcctaaacactagcactccaagcttaattacactatgcgtacaccaattaaaaaatgtcacgaaacattctataaacaaattagatatttactcctaatagtattatacatatgtgcaaagtctcatattcaaattcaatatattttagctgtaacaaaaagtgaaaaaaacccgaattttagctgtaacaaaaagtgaaaaaaaacccgacagttttaagggtaaaaatatcaggattttgtcttttttatggctaaaatataatgaaattgaagataagatttcacatgtaggtgtaaaactattggaagtatgtgtccaattttttctaaaattttttatgacatttgctaattgatatgtatagtgtgtacataagtaaagcttgtgtgtataggatatgttctctaattataggtggactatatattccacgtagtaactacatttgacttggtcgatgcatcggcacagatgaaatcatagctatttaaagccccctacattcccgggaattctcatcgatcgatctcacctgcagcagcaaacgagcaccacacaccagcagcagcagcaaagtcgatcgatcgtcagcacacacgaccaagatcgag

SEQ ID NO: 61 - DNA, 1500 bp, Oryza sativa
ttaaagatgatttctccaccagtgtaaaatgtgatgtgctattgagatatttcactgtgtttcctaaaaatactcatcgtcgttaattgttggttggcattcgtagtttattttgtagcagctgagcaattttaattagtctatttagcttgtaagattcttatatttcttagcaatagccgagcgcattattgggctatagtgtaaccaggtgaagcgtacgcgtgtgcataagttgtccttgtggttgaaagaagaatactggaaggatcgttggatgttactgctgatatgatggacacttggatccaaacatcatgaatgcgctcaactacttgcatgttccaagtgtacaacatgcatgctagctgctacaaacgactagctctgttaggccgctgctaatcattttctcatcactaatactaacactgtgtgactagctagctaaaccagccctaacaaccaaccaccctgattcaattgaattgaattgaataacattagacgcaccgacgactaagtgcagtcccaaccctccacctaaaatggtgtctatatatggcattaactaaattgtcatgtatgacttttaacttatgtggcactatattaatatattaattaagaaggagagtgaagagaggaagaaactgggtctcatgcaagacacagcttcaacacgagaatctatgcactagacactatcaagttttgcattggaagagaatagtgtctttataatagttgaagaataaatatgattggtagagaagagagatgatgtatttattaatggcccactttaagaaatcatgggttgtggagtgtagtttttattgtgatgtcttattgacatgacaccatagacactgcttatggacattatgggttggaactgccctaagaacggtgcctaaacactagcactccaagcttaattacactatgtgtacgccaattagaaaatgtcatgaaacattctataaacaaattagatatttactcctaatagtattatacatatctggaaagtctcatactcaaatttaatatattttagctgtaacataaagtgaaaaaacccgacagttttaagggtaaaaatgtcaggattttatctttcttgttatggctaaaatataatgaaactaaagataagatttcacatataggtgtaaaactattggaagtatgtgtctaattttttctagaacttttgtggcatttgctaattgatatgtatagtgtgtacataagtaaagcttctgtgtataggatatgttctctaattataattataggtggactatatattccacgtagtaactacatttgacttggtcgatgcatcggcacagatgaaatcatagctacttaaagccccctacattcccgggaattctcatcgatcgatctcacctgcagcagcaaacgagcaccacacaccagcagcagcagcaagtcgatcgatcgtcagcacacacgaccaagatcgag

SEQ ID NO: 62 - DNA, 2112 bp, Sorghum bicolor
atggctactgtgaacaactggctcgctttctccctctccccgcaggagctgccgcccacccagacggactccaccctcatctctgccgccaccaccgacgatgtctccggcgatgtctgcttcaacatcccccaagattggagcatgaggggatccgagctttcggcgctcgtcgccgagccgaagctggaggacttcctcggcggaatctccttctccgagcagcaccacaaggccaactgcaacatgatccccagcactagcagcacagcttgctacgcgagctcgggtgctaccgccggctaccatcaccagctgtaccaccagcccaccagctccgcgctccacttcgctgactccgtcatggtggcctcctcggccggcggcgtccacgacggaggtgccatgctcagcgcggccagcgctaatggtagcgctggcgctggcgctgccagtgccaatggcagcggcagcatcgggctgtccatgatcaagaactggctgcggagccaaccagctcccatgcagccgagggtggcggcggctgagagcgtgcaggggctctctttgtccatgaacatggcgggggcgacgcaaggcgccgctggcatgccacttcttgctggagagcgcggccgggcgcccgagagtgtctcgacgtcggcacagggtggagccgtcgtcacggctccaaaggaggatagcggtggcagcggtgttgccgccaccggcgccctagtagccgtgagcacggacacgggtggcagcggcgcgtcggctgacaacacggcaaggaagacggtggacacgttcgggcagcgcacgtcgatttaccgtggcgtgacaaggcatagatggactgggagatatgaagcacatctgtgggacaacagttgcagaagggaaggacaaactcgcaagggtcgtcaagtctatttaggtggctatgataaagaggagaaagctgctagggcttatgatctggctgctcttaagtactggggtcccacgacaacaacaaattttccagtgaataactacgaaaaggagctggaggatatgaagcacatgacaaggcaggagtttgtagcgtctctgagaaggaagagcagtggtttctccagaggtgcatccatttacaggggagtgactaggcatcaccagcatggaagatggcaagcacggattggacgagttgcagggaacaaggatctctacttgggcaccttcagcacgcaggaggaggcagcggaggcatacgacattgcggcgatcaagttccgcggcctcaacgccgtcacaaacttcgacatgagccgctacgacgtcaagagcatcctggacagcagtgcgctccccatcggcagcgccgccaagcgtctcaaggaggccgaggccgccgcgtccgcacagcaccatgccggcgtggtgagctacgacgtcggccgcatagcctcacagctcggcgacggcggcgccctggcggcggcgtacggcgcgcactaccatggcgcctggccgaccatcgcgttccagccgagcgcggccacgggcctgtaccacccgtacgcgcagccgatgcgcgggtggtgcaagcaggagcaggaccacgcggtgatcgcggccgcgcacagcctgcaggagctccaccacctgaacctgggtgctgccgccggcgcgcacgacttcttctcggcggggcagcaggcggcgatgcacggcctgggtagcatggacaatgcatcactcgagcacagcaccggctccaactccgtcgtgtacaacggtgttggtgatagcaacggcagcaccgtcgtcggcagtggtggctacatgatgcctatgagcgctgccacggcgacggctaccacggcaatggtgagccacgagcaggtgcatgcacgggcacagggtgatcaccacgacgaagccaagcaggctgctcagatggggtacgagagctacctggtgaacgcagagaactatggcggcgggaggatgtctgcggcctgggcgactgtctcagcgccaccggcggcaagcagcaacgataacatggcggacgtcggccatggcggcgcacagctcttcagtgtctggaacgatacttaa

SEQ ID NO: 63 - protein, 703 aa, Sorghum bicolor
MATVNNWLAFSLSPQELPPTQTDSTLISAATTDDVSGDVCFNIPQDWSMRGSELSALVAEPKLEDFLGGISFSEQHHKANCNMIPSTSSTACYASSGATAGYHHQLYHQPTSSALHFADSVMVASSAGGVHDGGAMLSAASANGSAGAGAASANGSGSIGLSMIKNWLRSQPAPMQPRVAAAESVQGLSLSMNMAGATQGAAGMPLLAGERGRAPESVSTSAQGGAVVTAPKEDSGGSGVAATGALVAVSTDTGGSGASADNTARKTVDTFGQRTSIYRGVTRHRWTGRYEAHLWDNSCRREGQTRKGRQVYLGGYDKEEKAARAYDLAALKYWGPTTTTNFPVNNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHAGVVSYDVGRIASQLGDGGALAAAYGAHYHGAWPTIAFQPSAATGLYHPYAQPMRGWCKQEQDHAVIAAAHSLQELHHLNLGAAAGAHDFFSAGQQAAMHGLGSMDNASLEHSTGSNSVVYNGVGDSNGSTVVGSGGYMMPMSAATATATTAMVSHEQVHARAQGDHHDEAKQAAQMGYESYLVNAENYGGGRMSAAWATVSAPPAASSNDNMADVGHGGAQLFSVWNDT

SEQ ID NO: 64 - DNA, 2112 bp, Setaria italica; identical to SEQ ID NO: 62

SEQ ID NO: 65 - protein, 703 aa, Setaria italica; identical to SEQ ID NO: 63

SEQ ID NO: 66 - DNA, 2064 bp, Brachypodium distachyum
atggctaccgtgaacaactggctgggcttctccctctccccgcaggagctcccgtcctccgccgctgccgccgccggcgacgtctccggcgccgacgtctgcttcaacatcccgcaagattggggcatgaggggatcggagctgtcggcgctggtggcggagccgaagctggaggacttcctcggcggcatctcttcctactctgaccatcacaaggcagccagaagcaacaacatgaacatcaatggcgccgccgcctgctacgcgagctccggcagcagcggctaccagctttaccacgaccaccccaactccctccagttcgccgactctgtcatggtcgcttcctccgctggcggcgtccacaatgaacatggcatcatggcaagcaccactgccaatggtgcaggcaccaatggcggcatcgggctgtccatgatcaagagctggctgcggagccagccggcgccggcgcagcaggagcagcagagggcggaggggctgtcgctgtccatgaacatgccgctcctgcaggcggcggcggcggagactagcttgtccacgtcggcagcgcagcagggatctcggaaggagaataatggcagcagtagtgctggttctggagccgtggtgtcagccggtactaccagcgccggcgcggtggtggtggagtcgccggcagcggggaggaagaccgccgacacgttcgggcagcggacttcgatctaccgcggcgtcaccaggcatagatggacagggaggtatgaggctcacctgtgggacaacagctgcagaagagaaggacaaactcgcaagggtcgtcaagtctatctcggtggttatgacaaagaggagaaagctgcaagagcttatgatttggctgctctcaagtattggggccccaccacgacgacaaattttccagtagataactacgagaaggagctggaggagatgaagcacatgacaaggcaggagtttgtggcgtctctccgaaggaagagcagtggtttttcaagaggtgcatccatttatcgtggagtaactaggcaccaccaacatgggagatggcaagcaaggatagggagagttgcagggaacaaggatctctacttgggcactttcagcacgcaggaggaggcggcggaggcgtacgacatcgcggcgatcaagttccgggggctgaacgccgtcactaacttcgacatgtcccgctacgacgtcaagagcatcctcgacagcaccgccgcgctgcctgtcggcggcaccaagcgcctcagggacgcggctgccgccgatcagcactaccagcagcgcgccgggggcgtcgtcagctacgccgcgccgcagctcggtggtgtcaacgagaccgcccttgcctatggcgcgccctactaccaccaccaaacctccgccgcagcgtggccgaccatcgcgttccaggcggcgccgcaagcgtcgtcggggcacgggcacatgctgtaccacccgtacgggcagccattgatgcgcgggtggtgcaagcaagagcaggagcaagggcaagggcagcaggagccggaccacgcggtgatcgcggccgcgcacagcctgcaggacctccaccacctcaacctcggcgccggtgcgcacgacttcttctcccagcatgcccacgccatgcaccagcagcagcagcagcacggcggcctcggcagcgtcgacaacaacggcgcggcgtcgctggagcacagcactggctccaactccgtcgtctacaacggggccgctgccgccggggacaccaacaacagctacatgctgccgcccatgagcgctgcagcagcagctggcttcggcctccgcgatcagcaggacgaaggcgggaagatggcgtacgagaacttcctcctcggcgccgccaccgacggctactgtggccctggaaggatggcggccacctggacaccggtgtcggtttcggcggcccagccagtggcggcaacgagcagcggcagcgacatggccggtgccgtctgccatggcggcgcgcagctcttcagcgtctggaacgacgacagttag

SEQ ID NO: 67 - protein, 687 aa, Brachypodium distachyum
MATVNNWLGFSLSPQELPSSAAAAAGDVSGADVCFNIPQDWGMRGSELSALVAEPKLEDFLGGISSYSDHHKAARSNNMNINGAAACYASSGSSGYQLYHDHPNSLQFADSVMVASSAGGVHNEHGIMASTTANGAGTNGGIGLSMIKSWLRSQPAPAQQEQQRAEGLSLSMNMPLLQAAAAETSLSTSAAQQGSRKENNGSSSAGSGAVVSAGTTSAGAVVVESPAAGRKTADTFGQRTSIYRGVTRHRWTGRYEAHLWDNSCRREGQTRKGRQVYLGGYDKEEKAARAYDLAALKYWGPTTTTNFPVDNYEKELEEMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSTAALPVGGTKRLRDAAAADQHYQQRAGGVVSYAAPQLGGVNETALAYGAPYYHHQTSAAAWPTIAFQAAPQASSGHGHMLYHPYGQPLMRGWCKQEQEQGQGQQEPDHAVIAAAHSLQDLHHLNLGAGAHDFFSQHAHAMHQQQQQHGGLGSVDNNGAASLEHSTGSNSVVYNGAAAAGDTNNSYMLPPMSAAAAAGFGLRDQQDEGGKMAYENFLLGAATDGYCGPGRMAATWTPVSVSAAQPVAATSSGSDMAGAVCHGGAQLFSVWNDDS

SEQ ID NO: 68 - DNA, 3769 bp, Sorghum bicolor
atggctactgtgaacaactggctcgctttctccctctccccgcaggagctgccgcccacccagacggactccaccctcatctctgccgccaccaccgacgatgtctccggcgatgtctgcttcaacatcccccaaggtatgcatctatcgatcgatatatgtacgtacagtgcgcatatatatatatatctgcagtttgtggtacgaatactgattgaagctagcatgaaatgtcgtttgttctttcagattggagcatgaggggatccgagctttcggcgctcgtcgccgagccgaagctggaggacttcctcggcggaatctccttctccgagcagcaccacaaggccaactgcaacatgatccccagcactagcagcacagcttgctacgcgagctcgggtgctaccgccggctaccatcaccagctgtaccaccagcccaccagctccgcgctccacttcgctgactccgtcatggtggcctcctcggccggcggcgtccacgacggaggtgccatgctcagcgcggccagcgctaatggtagcgctggcgctggcgctgccagtgccaatggcagcggcagcatcgggctgtccatgatcaagaactggctgcggagccaaccagctcccatgcagccgagggtggcggcggctgagagcgtgcaggggctctctttgtccatgaacatggcgggggcgacgcaaggcgccgctggcatgccacttcttgctggagagcgcggccgggcgcccgagagtgtctcgacgtcggcacagggtggagccgtcgtcacggctccaaaggaggatagcggtggcagcggtgttgccgccaccggcgccctagtagccgtgagcacggacacgggtggcagcggcgcgtcggctgacaacacggcaaggaagacggtggacacgttcgggcagcgcacgtcgatttaccgtggcgtgacaaggtaataagggtccggtattacaatgaatcgtcacttcgtcagagaactaaactagcacaaatcagcaatgaatcaagtaatatcatgaaatttagaaaagccgttagcaatgcaaggagctatcattatagatttgattgcatctagacagttctgaattaaatgagtagggcaatgtgtagcctttgatgatctcgctgattattaggagtgccatttgtattggctatgattgtggtatatacagcagtagacaattaacaaaaggctaccactttcgaattattttaggcatagatggactgggagatatgaagcacatctgtgggacaacagttgcagaagggaaggacaaactcgcaagggtcgtcaaggtaccaatataatgcaatacaccgtatttaaatatatatgcttttctgtaattaagtttatactttcacaaaactgacattacttcgcattatcatttttggattgtcgtcgtcatgattggcgggattgaaatgaactattgaatctacagtctatttaggtaagcgatttcacttggttattaatttgggaccaactacttaatccagtttgtttttcccctataaccattattttttcatctgtgttctcaactcttacttttccatcttgttccactgataggtggctatgataaagaggagaaagctgctagggcttatgatctggctgctcttaagtactggggtcccacgacaacaacaaattttccagtatgtatatgtagaatgcagttttacttcactgaagatcatacctttgctatgtctcaaatgccgttcattagttagtggatctgaagtgaaggttctgtaatttttgttaactatgtacattgctggaattgtacttaaagtcatttgtttttgtatatctaggtgaataactacgaaaaggagctggaggatatgaagcacatgacaaggcaggagtttgtagcgtctctgagaaggtcggtcgaacagcattgattaatcaatgccaactctattgaataaacatctactctgttaattgttaaagtttgagagaaagatctgcatgttagatcttaatagaccactgtatatgaatgcaggaagagcagtggtttctccagaggtgcatccatttacaggggagtgactaggtatgaattcatataatggcgtcaacaaacacacatacactttgattgaggaggcgaatgcacgcatggattgaatgtgaatggtgttttacttgaactatgtaattataggcatcaccagcatggaagatggcaagcacggattggacgagttgcagggaacaaggatctctacttgggcaccttcagtaagtatcagagatgttttctcattgtatatagaggagtacttctatatgtatatatacattcagttattcaccacacaaaagcaaattgcagtcaactaataacaatctcaacgcaatgagaagcaagtgttacagctgatagtacacatttgtagaccttctgcatatggatgttatatatgatgactattaaaaatgtgaccattgcatcaagtcatgcaaagttgcattgcagtagtacatacattacttagtgcatgctcctcaagtggctttttcaaacctgatcccatgtctggcgctattgttgtctcccattcacccgtgcatcaggtcaaaatagtactatgcctcaataagaaacacatgagcatgcactggcagcagcagactaatcaagttctatcatttactaataaactaattaggctacagcatccaaaagattctacccattaagccacaactgttcatgcatgcattcataaaccaggataccaccatgcatgcgtgcaccgtgttcgtgcttggaatattgagctgagccgagtgcacccttgcgtggatgcaggcacgcaggaggaggcagcggaggcatacgacattgcggcgatcaagttccgcggcctcaacgccgtcacaaacttcgacatgagccgctacgacgtcaagagcatcctggacagcagtgcgctccccatcggcagcgccgccaagcgtctcaaggaggccgaggccgccgcgtccgcacagcaccatgccggcgtggtgagctacgacgtcggccgcatagcctcacagctcggcgacggcggcgccctggcggcggcgtacggcgcgcactaccatggcgcctggccgaccatcgcgttccagccgagcgcggccacgggcctgtaccacccgtacgcgcagccgatgcgcgggtggtgcaagcaggagcaggaccacgcggtgatcgcggccgcgcacagcctgcaggagctccaccacctgaacctgggtgctgccgccggcgcgcacgacttcttctcggcggggcagcaggcggcgatgcacggcctgggtagcatggacaatgcatcactcgagcacagcaccggctccaactccgtcgtgtacaacggtgttggtgatagcaacggcagcaccgtcgtcggcagtggtggctacatgatgcctatgagcgctgccacggcgacggctaccacggcaatggtgagccacgagcaggtgcatgcacgggcacagggtgatcaccacgacgaagccaagcaggctgctcagatggggtacgagagctacctggtgaacgcagagaactatggcggcgggaggatgtctgcggcctgggcgactgtctcagcgccaccggcggcaagcagcaacgataacatggcggacgtcggccatggcggcgcacagctcttcagtgtctggaacgatacttaa

SEQ ID NO: 69 - DNA, 4857 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcccaagcttgataattcgagctcggtacccactggattttggttttaggaattagaaattttattgatagaagtattttacaaatacaaatacatactaagggtttcttatatgctcaacacatgagcgaaaccctataagaaccctaattcccttatctgggaactactcacacattattatagagagagatagatttgtagagagagactggtgatttcagcggcatgcctgcaggtcgactcagatctgggtaactggcctaactggccttggaggagctggcaactcaaaatccctttgccaaaaaccaacatcatgccatccaccatgcttgtatccagctgcgcgcaatgtaccccgggctgtgtatcccaaagcctcatgcaacctaacagatggatcgtttggaaggcctataacagcaaccacagacttaaaaccttgcgcctccatagacttaagcaaatgtgtgtacaatgtggatcctaggcccaacctttgatgcctatgtgacacgtaaacagtactctcaactgtccaatcgtaagcgttcctagccttccagggcccagcgtaagcaataccagccacaacaccctcaacctcagcaaccaaccaagggtatctatcttgcaacctctctagatcatcaatccactcttgtggtgtttgtggctctgtcctaaagttcactgtagacgtctcaatgtaatggttaacgatatcacaaaccgcggccatatcagctgctgtagctggcctaatctcaactggtctcctctccggagacatggtggatccccgggtaccctgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatgggaattatcgaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagcccgggggatccaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggccgaagctaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattcagtacattaaaaacgtccgcaatgtgttattaagttgtctaagcgtcaatttgtttacaccacaatatatcctgcca

SEQ ID NO: 70 - DNA, 15629 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgaagcttgcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccgggggatctcgactctagccgatccaatccatggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggcgcgacggctccctctttcccgggcttctacgtcggcaatggcggcgccgtgcagacggatcaggccaacgtcgtcaactgggactgcaccgctatggcagccgagaaaaccttcctgcaggactacatgggcgtgagcggcgtcggttgcgccgccggggcggccccgacgccgtgggcgatgacgacgacgactcgcgagcccgagacgcttccactcttcccagtcgtcttcgtcggcggcgacggcgcgcatcgtcacgccgtccacggcggtttcccgtccaacttccagcgctggggttctgctgctgctacctccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtgaggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactctagaggatccatggccactatgaacaactggctcgccttctcgctctcgccgcaggaccaactcccaccgtcgcagaccaatagcactctcatctccgctgctgcaaccaccacaaccgcaggcgattcgtcaacgggcgacgtctgcttcaacatccctcaagactggtccatgcgcggaagcgagcttagcgctctcgtcgcggagcccaagttggaggatttcttgggaggcatctccttctcggagcaacagcatcatcacggcggaaagggcggtgttatcccaagctctgctgccgcatgctatgcaagctccggctccagcgtgggctacctctaccctccgccttcatcctcgtcacttcagtttgcagacagcgtgatggtcgcaacctcatctccagtggttgcgcacgatggcgtgagcggtggcggtatggtctcagcagcagcggctgcagcagcttcgggtaatggcgggattggcctctccatgatcaagaactggctcaggagccaaccggctccgcaacctgcgcaagcactcagcctgtcgatgaacatggctggtactactaccgctcaaggtggaggcgcaatggcacttctcgcaggcgctggcgaaagaggaaggaccacaccagcatccgagagcctctctacttccgcgcacggagccaccacggctacaatggctggcgggaggaaagagatcaacgaggaaggatctggatccgctggtgccgtggttgcagttggctcagaatcaggtggatccggcgctgttgttgaagctggtgccgctgcggcagcggctcggaagagcgttgatactttcggccaaagaacgagcatctacagaggcgttactcggcaccgctggaccggcaggtacgaggcacacttgtgggacaacagctgtcgccgcgagggccaaactaggaagggaagacaggtctatctaggaggatatgacaaagaggagaaggctgccagagcgtacgacctggccgcgttgaagtactggggtccaacaacgacgaccaacttcccggtgaacaactacgagaaggagctggaagagatgaagcacatgacgcggcaggagttcgtcgcttctctcaggcgcaagtcatctggtttctccagaggtgcgtcgatctatagaggagttacccgccaccaccagcacggaaggtggcaggcaagaatcgggagagtcgccggtaacaaggacctgtacttgggaaccttctcgactcaggaggaggcagcggaagcgtatgacattgcggcgatcaagttccgcggtctcaatgccgtgaccaacttcgacatgtcacgctatgatgtcaagtcgattctggatagcgctgcgttgcctgtgggaaccgctgccaaacgcctcaaggacgcggaagcagctgccgcgtacgatgttggcaggattgcctcacatctcggtggagatggagcttacgctgcccactacgggcatcatcaccactctgcagccgcagcttggcctacaatagcattccaagcggcagcggctcctcctccacacgctgctggtctttaccatccgtacgcgcaacctctccgcggttggtgtaagcaggaacaagatcatgcggtgattgcggctgcacacagcttgcaagatctgcatcacctcaatctgggagccgcagcagctgcccatgacttcttctcacaagccatgcagcagcagcatggcctgggcagcatagacaatgcgtctctggagcactccaccggatcgaactcggtggtgtacaatggagacaacggcggaggaggtggaggttacatcatggcacctatgtcagcggtctctgctaccgctacggcggtggcctcatcccacgaccacggtggagacggcggcaagcaggtccaaatgggctacgactcctaccttgtgggagctgacgcttacggcggaggaggagctggtcgcatgcctagctgggccatgacgcctgcttctgctcctgcggctacgagctcgtcggatatgacaggagtgtgtcatggcgcccaactgttctcggtgtggaatgatacatagggtacccgggccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggccgaattcgagctcggtaccctgggatccgatatcgatgggccctggccgaagcttggtcacccggtccgggcctagaaggccgcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 71 - DNA, 15647 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgaagcttgcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccgggggatctcgactctagatccaatccatggcggccaatgtgggcggaaagagtgttgtcggcggcggtgctggggcgggaggcactaccggcggcggcgcggcggcgtgccgcgccagcgggtcgcggtggacgccgacgccggagcagatcaggatcctcaaggagctctactacgggtgcggcatccggtcgcccaactcggagcagatccagcgcatcaccgccatgctgcgccagcacggcaagatcgagggcaagaacgtcttctactggttccagaaccacaaggcccgcgagcgccagaagcgccgcctcaccaacctcgacgtcaacgtccccgctgccgccgcggccgacgtcggccacctcggcgtgctctcgctctcgtcgccttcaggcgcggcgcctccctcctccccgttgggcttgtaccccggcaatggcggcgcgtcggcgttgcagctggacacgagctccgattggggcagcaccaccgccgtggccaccgagacatgcttcctgcaggactacatgggcgtgatgaggagcaccgccggccaccacgacagcagcgccggcggcgccgcggcctcgccgtgggcatgtttctcgtcgccggactcgtgggcggcggcaccggcgatgacgcgggcgcccgagacgctccctctcttcccgactggcgacaacgtccagcccccgcggccgcggcgcggagcaccagcaggcgacgccatccgcggcggcggcggcggtagcggctacctccccaccctgccgttctggggtgccgctgccacggctgccaccgccaccaccaccaccacttccgttacgatccagcagcaacaccaccagctgctgcagctgcaagaccagtacagcttttacaccaccaacagccagccgcccagcagccatgacgcatcatcagcggctactgcatccctggagctgagcctgagctcctggtgctccccttaccctgcagggaccatgtgaggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggctactgtgaacaactggctggctttctccctctccccgcaggatctgccgccttcccagacggattccaccctcatctccgccaccgccaccgacgaggtctccggcgacgtctgcttcaacatcccccaagattggagcatgaggggatcggaactctcagcgctagtcgccgagccgaagctggaggacttcctcggcggcatcaacttctcggagcagcaccacaaggccaacctcaacgtgatccccagcagtagtaacgcttgctacgcgagctcaggcgctagcacaggctaccaccagctgtaccaccaccaaagctccgcgctccatttcgctgactccgtcatggtggcctcctccgccggcgtccatgacggcggtgccagcatgctcagtgcagcggccaccgtcaatggcggcgctggcgctgccagtgccaacggcggcagcatcgggctgtccatgatcaagaactggctgcggagtcaaccagctccgccgctgccgcaaccgagagtagtggcggccgccgagggcgcgcaggcggcgcaggggctttctttgtccatgaacatggcaggggcgcaaggcgctggcatgccgcttctcgccggagagcgaggccgggcgcccgagagcgtgtccacatcagcacagggtggagcagtcgccgctcggaaggaggatagcggtagcagcggcggtgccggcgccctactagccgtgagcacagacacgggtggcagcggcacggttgctgagacggcggcgaggaagacggtagacacgttcggccagcgcacgtcgatttaccgcggggtgaccaggcatagatggacagggaggtacgaggctcatctgtgggacaacagttgcagaagggaaggacaaactcgcaagggtcgtcaagtgtacctgggtggttatgacaaagaggagaaagctgctagggcttatgatttggctgctctgaagtattggggtcccacgacgaccacaaattttccggtgagtaactacgaaaaggagctggaggaaatgaagcacatgacaaggcaggagtttgtagcgtctctgagaaggaagagcagtggcttctccagaggcacgcaggaggaggcagcagaggcgtacgacatcgcggcgatcaagttccgcgggctcaacgccgtcaccaacttcgacatgagccgctacgacgtgaagagcatcctggacagcagcgcgctccccatcggcagcgccgccaagcgcctcaaggaggccgaggccgccgcgtccgcgcagcacgctggcgtggtgagctacgacgtaggccgcatcgcctcgcacctcggcgacggcggcgccctggcagcctacggcacgcactaccacgcagccgcagccgcctggccgaccatcgcgttccagccgagcgccgccgccgccggcctgtaccacccgtacgcgcagccgatgcgtgggtggtgcaagcaggagcaggatcacgcggtgatcgccgccgcgcacagcctgcacgagctcaaccacctgaacctgggcgccggcggcggtgcgcacgacttcttctcggcggggcaggccgcgatgcacggcctcggcagcatcgacaatgcctcactcgagcatagcaccggctccaactccgtcgtgtacaatggggttggggacagcaacggtggcgccgtcggcggcggctacatgatgccgatgagcgctgccacggcgaccacgacggcaatggtgagtcacgagcaggtgcatgcgcggtcacatcaaggggagcacgacgaagccaccaagcaggcggcgcagatggggtacgagagctacctggtgaacgcggaggcggcctacggtggcgggaggatgccttcgtggacgccggcctcggccccggcagcggcaagcagcaacgacaacatggccggcgttggccacggcggcgcgcagctcttcagtgtctggaatgacacttaagggtacccgggccgtgggtcgtttaagctgccgctgtacctgtgtcgtctggtgccttctggtgtacctgggaggttgtcgtctatcaagtatctgtggttggtgtcatgagtcagtgagtcccaatactgttcgtgtcctgtgtgcattatacccaaaactgttatgggcaaatcatgaataagcttgatgttcgaacttaaaagtctctgctcaatatggtattatggttgtttttgttcgtctcctaatatttgcctgggatcaaattttattggctggtgttcatttgacctccatgttcttgctaggctccattttttactctacagccataatatgtttgattgtttggtttgttctttgttgtacacctggttctgtcgagcttagttttcgacactggcttacagcttaacatgttgctattttattgggttctgattgctattttattgggttctgattgctagtttttgctgaatccaaaaaccatgttatttatttaagcgatccaggttattattatgatggtggctaagtttttttttttccaagggtaaattttctggattctccagtgtttctgtggccgaattcgagctcggtaccctgggatccgatatcgatgggccctggccgaagcttggtcacccggtccgggcctagaaggccgcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 72 - DNA, 15901 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgaagcttgcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccgggggatctcgactctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattcacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccgccaccgcggtggagctcgaattccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaagaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcagatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtcccccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttgtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggaagcttggtcacccggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 73 - DNA, 22782 bp, artificial sequence; identical to SEQ ID NO: 41
  Synthetic construct

SEQ ID NO: 74 - DNA, 19342 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagatctttattgcaatggacgacattatggtcaaaagaaaaccaatgtatccatgcccgaggtcgtaggcgtactcgcatgcactatgcagtgcctgtggctacaatggctaccaactgctgcagaatcgacaatgggcgtcactatagccacgtctgaggttgcatgtgtacccgtgagtactatgtagccgtgcgactataaagaaggctataaactacatcatattcgatgacacgggttctcatacatgtcaatgtgtcacactcgtcactatggctcatcaaagacatgcatgacatacgacacaatatcttcgacaaaatatgggtaattggacttttattgaacgagatccgttgttcagatagagatgtaacactctcctccattgttatatagaagggagatgcaaagcaacgtagagacatccctctttctcccgtatccttgcttggttccgtgatgtcacatccggaatacaataaccaaaagattatggaacgttacactatacacgaaaaaaaaaaagaatctcaatgaggcctcacaattctatgaaaatgtagttttttttaaaaaaaatcaaacgcagaagccccgtttctttctttttaagcactccatattaatatccagagtgacaaaaaagggaaatgcgacggaacaactcactccagcctgctctgagactcagacacgctttctattccataaagaaaaacctttcacgaggattgcaaaaaaatgcacggcgccagcagcagctactagataggaggccaactgcttgcgttcgactagcgcgcacttgctacttttaacgctgccgaaacgggccaggcacacgaaatccccgtaaaacgaaaagcctggtgctggcacaagcaaagaatttcccttttcattcccgaggcggcgatggagcttcgtgccgtcgagcacgcagtcgccatctccggcttgctcgctcgatcgcctcctgcgttgcgctgcgcagccttcccgaccccggccagcccattgttttcagtgcgcgcgtcgagccagtacgtgaagtcttcacacaggtggtttagtacgtgccaacgatcggaatgcgggagttcggaaccgatcgatcaacacggcccggccggggggccacgctagcttcgtgaccgttacatcctctactgctggcagagggttgtttttttttttttgtatcacagtcagaattaaatccacgagacgtatacgctcgcctggctcttggccggacgcggcggcgtgcacgttcgatccatgcactcacacgccggccgagtccgccggacgtcccggtgcttatcgcgacgacgacatggctgcacggcgcgcgtgcgggggaacacgagagggctccagcctccaggcctttgactacaaggctacagcccagcccacaccgacgaaatgcggctgccgttacagcgcacgagcacgcgccccgccatcacactctcatgccatgccatgcacctcctctttaaaaccccgcacgcccccacgccgcgcgcacacacacacatcgcctccctcctcctccccaagagccggcacagaggcaaaggccagccctccagtgacaggcagatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 75 - DNA, 18716 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgaagctggccgctctagaactagtggatctcgatgtgtagtctacgagaagggttaaccgtctcttcgtgagaataaccgtggcctaaaaataagccgatgaggataaataaaatgtggtggtacagtacttcaagaggtttactcatcaagaggatgcttttccgatgagctctagtagtacatcggacctcacatacctccattgtggtgaaatattttgtgctcatttagtgatgggtaaattttgtttatgtcactctaggttttgacatttcagttttgccactcttaggttttgacaaataatttccattccgcggcaaaagcaaaacaattttattttacttttaccactcttagctttcacaatgtatcacaaatgccactctagaaattctgtttatgccacagaatgtgaaaaaaaacactcacttatttgaagccaaggtgttcatggcatggaaatgtgacataaagtaacgttcgtgtataagaaaaaattgtactcctcgtaacaagagacggaaacatcatgagacaatcgcgtttggaaggctttgcatcacctttggatgatgcgcatgaatggagtcgtctgcttgctagccttcgcctaccgcccactgagtccgggcggcaactaccatcggcgaacgacccagctgacctctaccgaccggacttgaatgcgctaccttcgtcagcgacgatggccgcgtacgctggcgacgtgcccccgcatgcatggcggcacatggcgagctcagaccgtgcgtggctggctacaaatacgtaccccgtgagtgccctagctagaaacttacacctgcaactgcgagagcgagcgtgtgagtgtagccgagtagatcccccgggctgcaggtcgactctagaggatccgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttcggccgccccagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 76 - DNA, 18762 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagctcggtaccctgggatccgattgactatctcattcctcaaaccaaacacctcaaatatatctgctatcgggattggcattcctgtatccctacgcccgtgtaccccctgtttagagaacctccaaaggtataagatggcgaagattattgttgtcttgtctttcatcatatatcgagtctttccctaggatattattattggcaatgagcattacacggttaatcgattgagagaacatgcatctcaccttcagcaaataattacgataatccatattttacgcttcgtaacttctcatgagtttcgatatacaaatttgttttctggacaccctaccattcatcctcttcggagaagagaggaagtgtcctcaatttaaatatgttgtcatgctgtagttcttcacaaaatctcaacaggtaccaagcacattgtttccacaaattatattttagtcacaataaatctatattattattaatatactaaaactatactgacgctcagatgcttttactagttcttgctagtatgtgatgtaggtctacgtggaccagaaaatagtgagacacggaagacaaaagaagtaaaagaggcccggactacggcccacatgagattcggccccgccacctccggcaaccagcggccgatccaacggcagtgcgcgcacacacacaacctcgtatatatcgccgcgcggaagcggcgcgaccgaggaagccttgtcctcgacaccccctacacaggtgtcgcgctgcccccgacacgagtcccgcatgcgtcccacgcggccgcgccagatcccgcctccgcgcgttgccacgccctctataaacacccagctctccctcgccctcatctacctcactcgtagtcgtagctcaagcatcagcggcagcggcagcggcaggagctctgggcagcgtgcgcacgtggggtacctagctcgctctgctagcctaccttaagatatcggatccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 77 - DNA, 23983 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtacctagtacccttgtacttttggtttcacctgcatagagaaaacccacaagaatatgacagtctgatttgtcagtctcattctcaagcaacatttctctatccgttactttcatggtgaataacacaatccatcatcaatactttgtgttactcagaaactgaaagttattccgagtcttgcatatctttggacctactcgtttttctaccattattgctgattgttaagctctcgctacttgaatcggcattgttggagtgggaaggttcaaaaaattggagttatgactagttgtctctttctatgtacgatggagaaaatgaataaacaactgagaaaatggctcttgtttagttgatgatgctcttaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgcgctatagttccggacttacccttaagataacttcgtatagcatacattatacgaagttatgggcccacgcgtgaagagcggttaccagagctggtcacctttgtccaccaagatggaactgtcttcggccagaatggccaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtagctcgccaaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaagactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgccctaaggacccggcggaccgattaaactgattcggtccgacgcgttacctaataacttcgtatagcatacattatacgaagttattagctaactaactagtaagcttaagccatgggtcgacggatccgttaactagcgtggcatttggcaccgccgcacactatgcgagctaggagtgctagtttacagatgaaactatgaaaccaagaaaacacaattgtccgtagctagcgcgtggcgtcgtgtcaagcttcacacagtatcttcgttcttcactataaatcgcgcctgttgttcgtgagacccaccaccgtggataacagtcccctaataataagcgatcaacagcactgctgatggctgaacaccgaggcgccgccgcgcgtaaccatccgccggagcagcccgtcgtgccggcgaacgacgccttccccgaccgcgcccagcagctctgcctcgacgccgggcgcgcgctcgcgatgtgcggcgtgctcgtcgccgtccctcccgcattttacgcgtcgacgtcgcggacgacaccgcacttgccttcgtcggcttcgtcctctggatcatcggtgcgtggctgtgcctcctggcgctcacgcccttggctccacgggcggtgagggcgggcggggccgccgccagcaccttgctgatcaggtgcctgtccctttcatgaactactagcgcccgcgcccgcggccgccgggcacaagagaacacatcgatgttcgctgcgtacgtcagcaataaggcactctttgtcagtagtcgagtgcatatgttgggtgtttgccctgggagatttcaagtgttgtggccattatcccgcaggataaaaaatcggcggcttttggattgatacggaaaataacgatgtttcatgctcgtgttgtgtgtgtgacatcttgtcagccaagtttttaaccgttgctactccccctctgtgggctcagtgtgtggaccggaatacgtcgtacataggccgtagcctaagcccaatatgccgtttttcaggttggcctgtgtgacgacaagcgggtctcaaaagcccatcacgcaactggcctgcaattattggaggagagcgcgtcgagttggttccagaggctgcgtggtggggccggactctgcgacgacctctcgttcgcgtccgatttggttgccgtgagccgtgacgtaacgcctccttccgttcctccctatataagttccacccccgggtccggtttccccaagccccagtgacccccgatcccgatcgcgaaatctccgcacccgccggcaagggaccgaagcaagcctctctcccgaccgtcgcatcaaggtacgcgtccgctcgatctgtcctcttccttctcgatttgacttgctgtggtgcccgatcacgggatcagaatcgcaccagtgtagatttcgcatgttctaagatgtgttagtttccaggctaatccagttctcttgacgcccgatccgatcgagctccgtgtttatttcagcctaatcgtagtattcccctaaaatttcctcattagggggttcgcaagattgttggtcgacaggttcacttatgctcgatcgcttacttttagtcgattcatgctgcgtactattgttgccccccgtggttttatcttttctcgtgtgaaatccagtagatatagtagatatcgtagcattaggttttaattcaatcgattgattattgtatcatcaaaattgagaagttcgaatcatgcctatcatgctgcctcaaccgaaatcctgtatattgaagtttcaattcaattgattgatcattcattagattcaaccaaaatctagaaggttagatgacgcatgtcatgctgcctgcgtagtttacctttgatctgtttatgattaccttatcagtaggatatttgtgattttgggaagtagcactaactgattcatgctgacatgatgttccctttcagattatactgttgagtcctatctaattgatgctttgtatgctatatgaatacgtcatggtaaattagcagttaattagcatattagcaattgggcgtacctcatcaggattgctcttgtagatgtgtgtggtgatgtttcttgttcaattcatgttctgctttaaaagtatgtgttctctgtttgttaattaagattcatggttataatgatttggacctaattaatcagggttgcccttttagatgcgtggttacttgttgagttcatttttttcctgctatagttgtatgcgtttgttcattcatggttagatttgatttgtttcttctctattccatgccttccatatacttcaattgtagcttaacatgagatttctgtatatgcaggtcgaccgccggggatccacacgacaccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagagtcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacatacctcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 78 - DNA, 19789 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagctcggtaccctggttcacaaactcaatacaacacacagtggagtagggtattacgctccggcggcccgaaccactctaaatccttgtgtcctcgtgtgctcttccaccattaatgactgtaattgcagggacacgaagagttgtagcgcttttgccaacaagatccgctatatgctagtagagtggaacctgcacagcaacaagcatccaataatctgagaataagaattatgtgtggtgatggttctcatctctgcaactcgccattttcgcgagagaaccaaatccaagttggtgaagatcatgatttgggctcatgggctggcatagtagctattacctttgcaattgtggttcgaatctatccgatattctccttttcagggagagctaatgcttatgcttattgggtattttggtttgacactgcttcacgcccaaaaaaaggcaactatgtctgagttggatatggcccaaaaaaaggcagctatgtctgagttggatatggaagtcttctttcgtttagggtgaagtaagaccaagctcatgagcttattatcttaggtcggaacaaattagttgataggcatggcacatttatcaaattataatgattttaacagaaaagcaacacctctttttcagcagcaccagctttgcaagctgcaattgacactccaagcatagtatttgctccaaactcagcctgcatttcgcacaatatcatatctatttccatttggataaaatatattttccagaaatatgggaacagaatcaagatacagaaaaaagttgtggtagtagtggtaagtggaaacacaagtacagtgaaaagatagcattatttctgaacagtcaaattaaccgaaataagtagtatcacatactgcccctaaattgactacacccaatgtaaagaattgcttgagcatattgagccatcagttgtttgtttgtgtaacggatttgacaatgcagagttcaggagcaaaaaaccgcaaaggagagaaagagggaaaggatctcctagtatcccaccttgtggcgcgccctgtcaagtgcatgatggcctggtcgatctgcgtctgctgctgcggttccatcccaacgagtgcctccgacaccttgtcgttgatcacccgcaccgcgtaggcgacccccctggcgaggaacttccgcctctcggaggccccggccgcgtcggcggcggcgccctcgagcgcgcccacgctagccgtagatgctcggtgcacggccttgttggtgtgcaactcgacctcaacggccggtgcgctacgcccgtcaaggatctggcgcgcccgcaccctcgtgatcacggtgggcgcctcccgcctcatgtggccgacgatgaaaagcgccgggttaggggccttggcgcgcaccgccgtattcagggcctcctcgctcttgcgcgagagcaggtgcttccccaggtactcctgcactgacaaggctgccacagcggtggaatttgtcctcacgacttcgccacgtcgtcctcacctccctggcttcccacgactccgccgtatcgaggtgctcggtgggtcgtcttaatccgaagtccgaactaggaagacgagacagagaggtctgaggaatgggcctcgtttgatgttgagctgaattatttttccagcataagcccaggtcttggtccatgaacaaaattactagaaacccagcccagtactacgatctaaaagagggactgccactggatagctctctctagcattctccacgctccaatacagcggcgtcgtgtctatccgggtctatccgcgaacacgtgagaactctccagaaactgctttctcctccacttcatctctctcgctttccctctataaaaagaccccttctaggaattgagggagacagcaagcaccaagcagcgatccgaagctcaatcaattcactcaaacctcttccccaaatcttcgattagatcttcgttgacaagaagactagaaccgaacctgacatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 79 - DNA, 18619 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttaccgaattcgagctcggtaccctggggggcactcacgacaaccgtgaccctggcgtcgacaagagcgacagcggatgggttcccggcaagcagcaatttggtgatcagtggcgaagcagcggaagcagccgaactgttttatttttgtgggggagcgacgagagggagaggtggatgagcgggcttcaacagcgccgagcaatagcacgtcccggacgagagggaataataaatttggattttatatttctaagtgcactctgaatttataagtttataacatttaggggctgtggtataactgaataagttcaaaaatctaaacaagtgttttttaagtttagaaaccggaatgatataatcagcaaccgaaataacatagataaataagtttgagttctaaaacgatggtatttagaggacgcgatgacacggctgaatcacggcccaggcacggcccgtgataagttcattgcgattctccgccacagagcaaaggcccacgaaactcagataatgtcgaagcgggttgaggttagagcgcacgagaatgttcaagagaagccgacaagcgtggagaaccccgccccgccgtcgcgaagctctctcccctcgcactcccgggaccaggctacggcatctgtccggtagcttcaacgtctttccccatccttccacggcactcgtgacttgacctataaaaggagccgtcgatccacggtctccaaccaggaaagcaaagcgcttcgcaagcacaggcagtgatccgtaaccaaatccggacagtcttgagctctctcagtctcagcatttcagttcccagatctacatagccccagcccccaagtagcgcatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 80 - DNA, 19898 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagcttcggtccgggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 81 - DNA, 2105 bp, Zea mays
atggcttcaaaccaaacacatgcctaacttggtcaaacttgtctaaccttaggcgtggtaaactatggcaagttaggcagcaaaccaaacagccccttagtcgtcttacttcatgccacaatattataaaatgtcatatagttactctagctagccttcttgttgttcttggcctaaaccctgattttagatcaggcaacaacaacctctcgaaagaggactacaacaaaaactatgtgaaccctaccaacaacagcaacaccctagcaataggaacacacaacagctctgacaccacgagcacacaacaaaaaagaactttgcgtaaccaaagtagcttcatcctcatctaatgcatcctccaccacaacatcctcaacagaggtgacaacctaaagcaacgtgaatgtatctaaaggcacctcaatggtctactcggtggacatcattcagtgagaattagcttcaaatgcccattccatcacctcattagtggtaaggttcgtctctctatgaatctcttctctatgaatctttgtaccagaggtcctagtgggcatctcgccaaggacagagactgcagtgtttgtactggtgtccggacacaccaaggagtcgatagtcgcgcaggccaacgtgagagaggcaaggatagacgatggtgaatcttgcttcactggagaacatgggccaaagagctcgagcaagtcagagacagaagcatgcttctcatgcgcctccccatgatccaaatagttggccacacatggtagccacaccttgatgatagaagcctcctccttgacaggttgaaacacttccttcaaacaagctgaaaacatatgttgaaactctaaccgcaacgactcggccaaaggggtgaccaaggaatgaaggtgcaaaggtgtcgaggcaagagaggcacaacaccaacgacaaacatgatcgtcgtcctcaccacggaaaccgatggttgagaagccgacgggggattgagatgtccatgtgattgagacttggcgacggtgtcagctgacaacaacgtacttggcgaagacttggccactacctcagtactccaagtccctgattgttcaggatgatcacattggacagaggacttaactcgacgagcacgagaggaagaccgaaagtgacaatgccgctcctgatgaccaaggcagcgacaccgaatgcaacggaagaaagttcttgcgtgagctaacttggtgatcatgtgcgaggtagcgataacacctggccgagcccacctctcgaagtcaaagctcctctttgacttgctctttgcaacaacatccgatgacattggcaatatggtctgaagagggagtacttttgacgacgacgtgtccggtgataacgggtagcccagatgacggctcctgctagagacgaggcctctgttagcactaagatcggccactgtcatcgatgacggtagccaatctaggtaggagtgcggccctacatgaagggacatgcgctcgagaacgagcactcggcgagctcgaacggtgggcttgaggccgggcagatgctctccttccactctggtgtcttgctctccttccacgagctgagcgcagatgaatggcggagtggcaatactgggtctccttcctcgagcttgatggcccagcggaggagcgagcacatgctgtagcccccaatctggggttgggacttgggagggtggaggaactgatctgaacaagcatggatctggctggagataggtggtgacgagtaccatgcgttgacggcagcagagagtcgacaaccggcgcgcggggacaagtcggccttacctgcgaagtcgtcccggacggcaacagcagcatgctcccggccccggcggtggcggcgaaaatagcgagatgatgcactagacgcagcctgtacacggggcacggaggggcgtagttgttaaagtatgccgctgcagctagtatttgtctcagcgcagttttctagctagctaaaaatagttgaagaaatatacatacatgaatcggaaaggaaatcgtacacaggattacctaatatgtcgcatgtgacaccgaggcaccgagtaacggtgacaa

SEQ ID NO: 82 - DNA, 2123 bp, Zea mays
taggtggtgttcggctgagtgggacgaggcgcacaacgctagccgggaacggcgtatgatgatgcaaggtccctcccaccaccaaggcagccggagcctgggccaatatgcagaagcatggatacgccctattttttatttaggtatatagcactggattagatattatttcttactatctcgttggttttcttgcagtcggcatcacatggtggtcggccttgctccaccttcttggtctatgctatggcccataagggcaaggcgacgtccgacgtcacctacaacccggatgacaggtcggaggaggcaagagacatgggcgttactggattgccgatggggcaatcgactcatcctccactcccactctgtctcaggtgaccactcccactctgtctcaggtgagagcaaggagcatgagctcgagtccagccatacgacctcgacacgatagctcacagcatcgcatacaacaactcgaggttagtgcttctataactcatccttccttgagttatataccttctctttgagttactataacgttggcttgtaatattacagacccaactagaagaagagaggagggaacgtcaagagatggaggcgaggataatggcggagcgggaggcagagcgggaggctcgcctggcggctgatcagaggatggcggagatgttccagtacatgcagagccttggcgccgcatagggcttcgctccgccacctccattgttccctgcagttgaccctgctatgttccatactcctgtgagtatcaaaattgtagttacatgttggtaatgcatctggtataacacatgcaatctcttctctatgcagggccaatttggggcggcatccaacaaccctcatgaagggttcagcccaacgtagcaccagtccaacagccacctccatgagagttatgttttagtgtttagactttagaacatgtgttgaatactcatgtttgtgttggatacttatgtcagagcttgagacttatgagacttatgttcttgatacttatgtttgccttgagaacttggatatttatgtttgtgttggatatttatgtttgtgatgatatatgtgatgtatatatgtgatatatgtgatgtatatatggtatcttttgtttgtttggatggaatataaaaaacaaataaaaaggtgtatactggtcactttgccgagtgtgacactcggtaaataggtgctttgtcgagtatcagagacatagcactcggtaaagaaccaagacctgggcaccggtataggttctttgccgagtgtaatggctctggcactcggcaaagaagcacgctttgccgagtgccataccaagcactcggcaaagtacctaacatggggacccctctggcggattctttgtcgagtgctgtcaggcagacactcggcaaaggtaacttctttgccgagtgtcacctgggacactcggcaaagatgctgtctctgtcacccggcgccgtaacggctgcttttctttgccgagtgctccctgatactcggcaaacctatttgccgagtgtccgataaaaagtactcggcaaagaaggctttgccgatgcactgtgtaccgagccctctttgccgagtgcgacactcggtaaagcctttgccgagtgtttttaatggtttaccgagtgcttcagacactcggcaaagccgtcgattccgatagtgttttctatattttggttttattgtttttagaatatatttagacataatgtgtaccaagtatatctagaaaaaaatataagttagaataaagagaaaatacttgaataaaaaatcttgtttaaatctcatttttttaaacctaattcacattttttaaagatccacctgcatgaccttattgatgttcaaatgtcaagctagctagaattgccatgtacgttgtggcagcgagttcgaaaatgattagcaggacgccacgaatcacgctaaatttatttatcttctactgttccttggccggagatcgactcatcgcgtgctgccacgaatccaacacgcaaacccccaacgtgtcagccggctagatgcgacggctgactatttaaagcggtagatcgcgcggtcgcatc

SEQ ID NO: 83 - DNA, 2145 bp, Zea mays
gacgtttaaaaagccagtacactatgaaaattaagggatagtaccatcacacgcctccttatatagcaatatagcaaaaggataaacactacaagaggcaatatccaattttttttaagtaccttctaaagagagcggtgaagattaatgaaccttaatttatagatgagttattatatatagaatatgtaagtcattcatggtatagcaatttcataactattcttgttgaactctctatagcaatttcataccagacaaaaacttccaaatgaccaaagaacaattagagtggctatcaaagtttaaacacccgtcaaagccattagagatttacctctaacaccagatgatgactatgtactactcgttagagatagtttatttgtattctcattgaggagaaatttgatttcatatttgagactagatgattagaacatttattgttagtttgttgaccatataaatatattatccaagttgacaataacaatatggatctctctattcgataagacatactttatttaatatttaatgcaatgatgcaaatgtaactgaaatagtatattcactgccaacaaaaaaaggcaacaaaaggaaaaataaatgatggaaaaatctcatccaaattataacactatcatttaggctatgttttgagagaataaaacatcatattagaggagagactctattctttggattttatagatttagaacattgcttagattgtgttaaggataaattttcaaaacaatttaataaaacaaccaagcgtaatacacgagtattataaattattcacacaaacatttatgcatggttctttctcaataagaggagtagatggttatgatttatttatgaccttcatagatgattatgactatatttaccttgttaaagaaagatcataattcttataaaagctcaagttttttaaaataaaagttgagaatcaagataatttaaagatcaacatagtgatatatgaccgtgggagggagtatattagagacaccatatattatatatggacaagtactagaaccctttgcaagatttctccaagaaagtagcattgtatcctactataggaaaacattgagaaatcgtcggctaattaaatcaagaatgaagttacagaaagaagaaaccatacttcaatggacatgacatgttgtatgttgagttactctattttaccatattgtttatagatggaggtttaaaccgctatccacgtactcaacaaagttcctactaaattagtgcctaaaactcaatatgagttatagtctggaagaaatccaaacttgaactatttgtatatttggggatctttagcagctgagtcaataatctttaaccctaaacaaaggaaagtgaataaaagggcaagaagttgccattttattagctatcacagaagtcgaaagagtttcgattttactgtctaaacaaacacaataaatttgtagaaacacgacataaaatattactccacatgttctaaaataataaccgttttagctcttgttttttatgtctatatttagatggatgatgataaatctagacacatatataaaacatatatatcaagtattgtatgatctattaattgtctaaaacgaatttaaattgatacagatgggagatggaggagtattagagaatgagtaatcaagggaagcatggtacccagaaataaaccttgaggaaaagaagatgtacgtcccaattctaatagtttaagaaccatattttgaacatgttgaggttttaccatcagttcctcgagttgtcaataaaacccttgctacaaatttcgagtcatcgagcacgacaattgatgagccccaaataatggtgagtcgcgcatacctgcacgcgacacgacggtacgagggcacgggcgcacctgctcgagtgcatgccgcatgcctctaccgcgagcgttccacgacgttccgcatgcatggctggcacctgtcggagcaagggaaaaccagggcatgtcgtggacgcaccccacgaaaaccaaacgcctccacgtagcctcgccggctcccttgcgtgtctccgcttttcgcgcctccctacctatataagggcgcaccaacgtactcgaccgg

SEQ ID NO: 84 - DNA, 18287 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatggcccggaccgggttacccggccagaatggccgaattcgagatccctggccaccaaacatccctaatcatccccaaattttataggaactactaatttctctaacttaaaaaaaatctaaaatagtatactttagcagcctctcaatctgatttgttccccaaatttgaatcctggcttcgctctgtcacctgttgtactctacatggtgcgcagggggagagcctaatctttcacgactttgtttgtaactgttagccagaccggcgtatttgtcaatgtataaacacgtaataaaatttacgtaccatatagtaagactttgtatataagacgtcacctcttacgtgcatggttatatgcgacatgtgcagtgacgttatcagatatagctcaccctatatatatagctctgtccggtgtcagtagcaatcaccattcatcagcaccccggcaggtcgaccccgagctccctgcacctgccgaaggagatagaaccgatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagcttcggccgccccagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 85 - DNA, 18543 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtacaaaaaagcaggctccggccagaatccggtaagtgactagggtcacgtgaccctagtcacttaaattcggccagaatggcccggaccgggttaccgaattcctaactaactagctggtaattattggctgtaggattctaaacagagcctaaatagctggaatagctctagccctcaatccaaactaatgatatctatacttatgcaactctaaatttttattctaaaagtaatatttcatttttgtcaacgagattctctactctattccacaatcttttgaagctatatttaccttaaatctgtactctataccaataatcatatattctattatttatttttatctctctcctaaggagcatccctctatgtctgcatggcccccgcctcgggtcccaatctcttgctctgctagtagcacagaagaaaacactagaaatgacttgcttgacttagagtatcagataaacatcatgtttacttaactttaatttgtatcggtttctactatttttataatatttttgtctctatagatactacgtgcaacagtataatcaacctagtttaatccagagcgaaggattttttactaagtacgtgactccatatgcacagcgttccttttatggttcctcactgggcacagcataaacgaaccctgtccaatgttttcagcgcgaacaaacagaaattccatcagcgaacaaacaacatacatgcgagatgaaaataaataataaaaaaagctccgtctcgataggccggcacgaatcgagagcctccatagccagttttttccatcggaacggcggttcgcgcacctaattatatgcaccacacgcctataaagccaaccaacccgtcggaggggcgcaagccagacagaagacagcccgtcagcccctctcgtttttcatccgccttcgcctccaaccgcgtgcgctccacgcctcctccaggaaagcgagaggtacggcgatcgatcatcccccctccttctctctaccttcttttctctagactacatcggatggcgatccttggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccttggttagtaccctaagatccgcgctgttagggttcgtagatggaggcgacctgttctgattcttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtccactttaacttagccttggagccatgaaagcgctcaccgcccgccaacaggaggtcttcgacctgatcagggatcacatctcccagacaggcatgccaccaacaagggcggaaatcgcacagaggctcgggtttcgctcgccaaacgctgccgaggagcaccttaaggcgctcgcgcgcaaaggcgttatcgagattgtgagcggagccagccgcggaatcaggctcttacaggaggaggaagagggacttccacttgtgggcagagtggccgctgacgaaccactccttgcccagcagcacatcgaaggacactaccaggtcgacccatccctgttcaagccaaacgccgatttcctcctccgcgtgtccgggatggcgatgaaagacatcggcatcatggacggcgacctgctggccgtccataaaactcaggacgtgcgcaacggccaggtggtggtggcccgcatcgacgatgaggtcacggtgaaacgcctcaagaagcagggcaataaagtggagctcctccccgaaaatagcgagttcaaaccaatcgtggtcgaccttcggcaacagtctttcacgattgagggcctggcggtgggcgttatcaggaacggcgattggcttggaggatccagctcccaacagcaacaacagcagcaacagcagcagcagcagcagcaacagcaacagcaacagcagcagcagcagcagcagcaacagcagcaacaagtgtgggcgcccaaggccgtgcggtgcacgggcggactcttcttcttccaccgggacacgacgccggcgcacgcgggcgagacggcgacgccaatggccggaggaggattaggaggagaagcagggtcgtcggaagattgcagctcagcggcgtcggtatcgcctctcgtcggaagccaggacgagccgtgcttctccggcgacggtgactgcgactggatggacgacgtgagggccctggcgtcgtttctggagtccgacgaggactggctccgctgtcagacggccgggcagcttgcgtagctcgaggtttttctcagacagttttctaaaaaaagggcgtttctggggaagttcgagatggttcgtaaggtgttactggctcctgtgaaccaatacatgatactgccatgataagggttataattagtcaagcagagtaagaagaaacaacagtagcagtgactccgattcctgaagatgagtcatatttgtcttgtgctcctgctgtatgaaatggatcgcatgtgtatattcgtcgccgcgccgcactggtgtaacctgttgcctcagagtttgcttttagctggttctgttttaaaaataagtactgttttttggttggctgcaagccattctgaacttcagtttaccaattgtttttatgttgtggttgaatattttaattttttatttaatgtttggttctttttttatatatatttgcaaaaatgatacaagtggtcaagttttcatatagtatgggctctatttcctagagctctacctctaggaacgaattttgtggaggttttcttttggctagttaggcaaagtccccatatcttgcaggctaaatcaagaagaagctctgtcaaacagttttttttactgaaaagtgattaaagagtagtttctcctagatcacttcagagtttatcctagagaatcatgggaatcaaattcagttagaggatcatttcttacaaagaatcaactttcgtagagaatctaaagcagaaagagctttgacaaacttacccttagagcaattccaacattctcgcgtgagtttcttcgcgccgttgttttgcggtgacttcatctggacgtcccgcgacatagagacgcttgtattgatcatgagagcttgtgtggtcatacacaatataattgttaaagatgaaagagatgtggaccttaatgagcgattcgactttgatggtgaaaatgtgcaaccttctcatggtatttctactcgcacactagctgaatttattgaagctcataaaaagatccgagacaaagaaatacattttcaattgaaagaagacctaatcaagcacttatggtgtacacccgggaagcttggcgcgccggtcacccggtccgggcctagaaggccagcttcggccgccccgggcacccagctttcttgtacaaagtggcatcggccagaatggcccggaccgggttaccgcggccgcgaattctgtacaaccggtctaactaactagcaattcgcccttgatactgtatatactcacagtatcatatgatactgtatatactcacagtatcatatgatactgtatatactcacagtataagggcgaattggcccttgatactgtatatactcacagtatcatatgatactgtatatactcacagtatcatatgatactgtatatactcacagtataagggcgaattgctgcagcccgggacaatcccactatccttcgcaagacccttcctctatataaggaagttcatttcatttggagaggactatttttacaacaattaccaacaacaacaaacaacaaacaacattacaattactatttacaattacaccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtaggtcaactacccacggtaccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattccaaaccaaatctattctgaacttttgaagatctgtgatgtccggaagaaaagattcaaacagataaacgggactctccagaatctataaaataaatgatcgacaaacgctttgctttggtaggcttcaagcttggtcacccggtccgggcctagaaggccagcttcggccgccccgggcaactttattatacaaagttgatagatatctggtctaactaactagtcctaaggacccggcggaccgaagctggccgctctaggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 86 - DNA, 2222 bp, Zea mays
cctcttcctgtaccgcggcggggtgcacgtgcgtgccgacaacgacgacgacccggcgtgtgtgatccgccgcgcgctcggcgaggcgctggtgccgttctacccgctcgcggggcggctgcgggaggtggagggccggaagctggtcgtcgactgcaccggcgagggggtgctgttcgtggaggccgacgctgacgtgcggctggacgaactggaggcgaccgggctgaggccgccgttcccgtgcatggaccagctgctgttcgacgtggacggctccagcggcgtgctccactgccccctgctgctcatccaggtaccccaccagttttgccgcaaacaaaaaaaaaaaagctttcagacaatcagtggtgtgcgatatgatatgatacgatggtctcgtcgatcaccaggtgacccggctgctctgcggcggcttcgtcctcgcgctccgcctcaaccacaccatctgcgacgccatcggcctcgcccagttcatgtccgccgtggccgagctcgcccgcggcctccccgcgccgaccgtggcgcccgcatggtcccgcgagctcctcgaagcgcgcaacccaccgaagccggcgttccctcaccgcgagttcgacgtggcgccacctccgccacccccaccgccgggcgacatggtgacgcggaccttcaccttcagcccagccgacgtcgccgcgatcaagcgcgccctcccgctggctctccgcgaggcggccacgaccttcgaggcgctgacggcggccctctggcgcgcgcgcacggcggcgctggcgccccctcacgacgcggaggcgcggctggtgtccattgtcagctttcgtggccttcccgagctggcgctccccgcgggttactacggcaacgcgtgcgtgcccgtggccgcgctcaccaccgcgggggcactgctggcggggtcgctgggcgacgcggtggcgctggtgcgggggaccaaggcggcggtcaccgccgagtacgtgcggtccacgctggacctgctggtgctgcgggggcggccgtgcgtggcgctcgcgaacctgttcctcgtgtccgacaaccggcgcgcggagttccaccggctggacttggggtggggcgtgccggcgtacgggggtcctgccgtggcgctcttcgggttgagcttcttcgtccaggcagggaacggtgacgacgtcgccgtgttgatggcgctgccgcggccggctatggaccacttcgcgtcggaagtggagacgttgttgaaggcttagttgggtgttcttgaatcttgacgagcgagcgagagagcggcagagcgccgcctgttcttgctaatgctaactgtcttcgctcaaatttgtcgtctattcgtcgccaacgactctctccgatcgttcagtcagattcgcttggccatgtcaggtctggtctagatggaccatgccggcttgggcccaatcttgacaacgccgtgtttggtttggaccgaaataacaggcctctgagccatcgccattcactgggaacttaaaatggtgcagggttgttgttattgtccacgctaatccaagtgtgttgtgcttccgaatacagctatcaagagagtaaaattttaagatgaaaacccacagagataaaagttctccactatgtatgtatgttgttttaaactgtagtcatagaagaagtcaccgtgctcactgataggagggtctaaaagtagatgcattaatcaaaaacaaaacatacatcattgaactttaaaagcatataaccttcaatactaaataaaaagattagtattgtttaaatattagatactactgataaaaaagataaacaccattagctatattaccaccctctccaactgttttctgaactaattgtaaatgggcccatagtgtagtcgtcaagcatggaggcccgctcgaccgacctcctcgatcgctcaaatttggaaacagcggttgctactgaccggggtgagtgctgcgttgttggcgactgccctgttttttaatggattcagtgagagctaaaaagtgcgagactgcgagagaaatccagcaggtgtacgtacgtaaagcgagagtcgacgcgtgggcgcggcagacgcgagcctcccgccacgttggcctcgttcccgcgccacgcggccacgcctgcctgcctcctcaccttgtttatatgcctcgcgcctccctcaccgtgccaatgcc

SEQ ID NO: 87 - DNA, 2101 bp, Oryza sativa
ttttttaaggacagggggagtatgaagtagtcacatgaatgcccaaggaattaggaatttttcccgtgctacagattttaagtgagaaacacatgaatttttccattcactctgaacttatttttctattcatttgcgtaggatccagacaaacatgcagctaatccaaacaccttcatatgtttttcaattatctgttttgcatttatattcttatcatatttctatgtttttttatgtttctgtattttttttttcaatgatgcgttccgaataagccctctgcaagcagcaggtaacaatgggttgcaacagtcactgtcatagctgaagcctcggcgagcgacatgttcggaacggagcagaatgaatagtgtgctacctaatgattacattattcgagtagcaccttaagatcttaaatttaaccgatttggctatatctcactcgaaagatttttttcttatctcactcgattttctcactcaaatttacagggtattttcttgtaaattacagtgtaacttatgaaacttacattgtaatttttgtaagttgcagtgtaattttttaatctttgcatgtaagttttaaaatttatattggatttggtctttttcttgaagatatggtaatttattgtccattatggtgtttcttagttgctttttatcttttactgtgtctattggattttaatccaaaaattaaaaatctgtgtgatatggtcataaaaatcttttgaaagatgcataggtactcccaatttaattcttcatccgagcgaattttaaggcttagttaaagaaaaaaaaacttactaataaaggcccaccaataaaaccacgcgcgatcggaataagttcacttcgtcacccttaactgtgatcgaaatctaatccatgaccctaaaccacaaaaccagatatatcgacccccaaacttatgggcgccggcaactagcaaggagaggatggcacggaggaaggcccgcccgccgccgtcgtcgccgcctccgctcgggcctccctggcgcccatcgctatcgcctctgctcgatcctcctctggcaccaccgccgctcgagtcgggtggccgccgccgtttgggatgccccgtcgcccggcgtcgtcgcctctgctcgagccgagcggcctccgcccatgaggcgcgcggcgaggctaggtgtgcgcggcgtgttggcctcggagggtggcgcggacggcctgggccgcgcgagagcgccagaggccggctcgatctggacgccgatctggatgtcgccgcggaggaggttggcgtcgaggtcgaggctgttgcgtggcgcctggaggcctccgtcgtttgtgccgccccgtcgcccgacgccgtcacctccgctcgacctgcctctagcgccgccgccgctctagccgggtggccgccgccgtttggcctccccgttgcccggcgccatcgcccatcaccgcctgtgggagacgtaggggaagaaggggggagagagagaagggagaaagggaggaggaagaaggaaggaggatgacatgtggggtccacatgtcagtgggacccacaattttttttatgtgtgtgaatgacaaacgggtcccacaattgtaatgccatgtaagtgccacgtcaacgccacgtggatcgaagactcggtcaatattgccacgtaggcgccacgtaagcaaaaccgcctcccaaaaccgcgcagggagtcaaattgcaccggttttagaagtttgggggtcgagatatctggttttgtggtttagggtcatggattagatttcgaccacagttgagggtcatgaagtgaacttattcccgcgcgatcaaacgtgttaaggatccacgttgcggcccataaaggcccagatgtctctactatttcttcttctagtgagctccatcgaagcttttaggcgaggcctaccgctgtggctaagcggcggcgtgtgccagcccaacccccgacgacgacgacgcgtggcgacggccgccgcgacacccgccgccacgtcgccccgccacgcgccgccccccggcgagctcctcctcctcttttataatcccagcctcgtctcccccgcg

SEQ ID NO: 88 - DNA, 2137 bp, Sorghum bicolor
cggaattcataccttgtttagttcgcaaaaatttccaagattcaccgtcacatcaaatctttagtcgcatgtatagagtattaaaaatagacgaaaacaaaaactaactgtatagtttacttgtaatttgtgagatgaatcttttaagtctagttactctgtgattggataatatttgtcaaataaaaacgaaatgctagagtatctaaaaacaaaaaaaatttacgaaccaaattgcaagatctcgcagtcgcccgggtctccgccgccgccatcatagtcgctgcctgctctttgatagcgacgtcccggctgcccgcaacccgcaggcgctcgtccacgaagcaggagccatgacgccaccccaccactggtctgcttcctgcacccgcacgccaggcgctgagggtatccgccgccgcacgctacgcgctcgatccttcgccggttccatcggatcttcgtcgggtacccggccagcaggtatgtccaccccttctcttccctttacttctgaaatatgtatttagcatataaggatgattttgtgtagaccccattcagatgaaatatgtatttagcacagtcaaaaatttagcagatgcctcttgtttagcttttgagtgtgatctaacagttgcatttggagcataatgctttttaacaaattttaactgaatagctaacgtcaaaatggagcaatgcagccacatagggtcattattcttacaaggaaggacctggattcagcattcaaacttcaaagtaggcatatttaacacaaaaaatgatttctgatttctgaatcgtcttcatggatgcagacttgagtacttgatatttgttggcatataaatgataaaactagatttacagaaaataacatatagttcatcaaattatttcagttgacgggcctttcatagtatattcattagtatactaccactgattgctgacagggtgcaagccttctttgtgctttgatctgctttgctcttaatgttcataggccttgtgtgctcctcatccaccccaccgtggcggcatttggataggcagatcgaaagggatcaggatatgtgcccagtaagaattatcgtggagtgcacagagctatatgtatggttgtttacaagtggccaaataggcttgctcaacttgggattaacttatttatctttctaaaatgaaggtagcattccagtttatggccaccagggattgacttatttatcctcttgaaatatattccctccatctcaaattgtaagttatttcaaaaatcttggagagttaaacttttctaagtttgacccaatttatatgataaaataattattattatgatacaaactaagtatcattaaattcttttttaattatatttttatagtatactcactttacgttacaattcttagtatttctctctataattttggtcaaatgtaaaaatactttaactctccaagattcttggaatgacttacaatttaggatggagggagtaggtagcattccagtttgtggctatcatgcaagtacacatgcaatggtttccagttcagccatctaattgctttaaaacttagtgctgatcatagatgcagcaaaatggttcctatttagagctcatatactatatttgtttcatgaacttaattatgattgcaggactactacaaagttctagaggttgactatgacgcatcttacaataccatcaaatcaagttatcgaaaattacctttggtaagatgttgtacaacctccactcgtcaaactagaagataattatgtgcacacctgacgatgttctatcttttctgaattgtatggcattaagcggttgacacagttgtaagtatctaattatccccaagtgcactacccatctctattaaaactgtcaattcagaatttcagacagtgatgctactagcgaggtcgagtgggtgtaataagcggcggccggcgtgcgttggttggttctccgagcggccggactggacgcgtgggcgaggcagatgccagcctcccgccacgtccgccgccacgcgcccacgcctgcctgcctctccctcttgtttatatgccctcctcccctccaccccctcgtctccctcaccgtgcc

SEQ ID NO: 89 - DNA, 17326 bp, artificial sequence
  Synthetic construct
gtttacccgccaatatatcctgtcaaacactgatagtttaaactgaaggcgggaaacgacaatctgatcatgagcctagttagttaggggcagctaacgtcccctagctaactagttgctattaacctttagcctagtttagtgcggtcgcgctagtgaactagtctaatgggtgcctagcttagattagatccccgttcggcttagactaggttagtcggatagggctagtctagtggcttagcttggaactgttaagctaggctgttagtgcgggacttctaggctaacctattgacccctaacgcctagaacctaagaaacgctaaggacacctagctaactttggcgacgtccagaggtccgattccggctaactaactagcttaagcttgatatcatgataagaaaacatactagacattaataatctgctagaaatgggaagaatcacgcgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtgtcatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggtcacaccggttaaaaccaaaatccagtggcgagctctcgagtcgatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgggttaccgaattcgcctagaaggccatttaaatcctgaggatctggtcttcctaaggacccgggatatcggaccgattaaactttaattcggtccgaagcttcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctgctagcgaagttcctattccgaagttcctattctctagaaagtataggaacttcagatcctagaggatcgatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaaatccatcatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccagcttggtcacaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagctgggcaactttattatacaaagttgatagatcgagcgactaattaactagctgtcccacggcctaactagcacttaatcccctagcctaacctaagagcgctaatctaggctagtggtcacttagggctttaaggctagcgtatacgaagttcctattccgaagttcctattctccagaaagtataggaacttctgtacacctgagcctaactaactaggacgtcccgaggtccgattccgggctaattaacacctagctcgccactcgactaattagggactaagcctagcgcttagccgttaaaacctagcacaccctaagcacccttagttaggttcccctcttaattaagccctagtgagcccctaagttaaggggacgctaagagccccctaacctagtattcggctagaggcgaactaggctaaacacctaagcgcacctctttaagctagatcgctagggggctaggctagagcttcgctagattagtctaagggcagctaactaactaggtttaaactacattaaaaacgtccgcaatgtgttattaagttgtctaagcgtcaatttgtttacaccacaatatatcctgcca

SEQ ID NO: 90 - DNA, 18003 bp, artificial sequence
  Synthetic construct
gtttacccgccaatatatcctgtcaaacactgatagtttaaactgaaggcgggaaacgacaatctgatcatgagcctagttagttaggggcagctaacgtcccctagctaactagttgctattaacctttagcctagtttagtgcggtcgcgctagtgaactagtctaatgggtgcctagcttagattagatccccgttcggcttagactaggttagtcggatagggctagtctagtggcttagcttggaactgttaagctaggctgttagtgcgggacttctaggctaacctattgacccctaacgcctagaacctaagaaacgctaaggacacctagctaactttggcgacgtcccgaggtccgattccggctaactaactagcttaagcttgatatcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcaattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaaggttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacctccggattcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcacgcgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaacaatgccccagttcgacatcctctgcaagaccccccccaaggtgctcgtgaggcagttcgtggagaggttcgagaggccctccggcgagaagatcgccctctgcgccgccgagctcacctacctctgctggatgatcacccacaacggcaccgccattaagagggccaccttcatgtcatacaacaccatcatctccaactccctctccttcgacatcgtgaacaagtccctccagttcaaatacaagacccagaaggccaccatcctcgaggcctccctcaagaagctcatccccgcctgggagttcaccatcatcccctactacggccagaagcaccagtccgacatcaccgacatcgtgtcatccctccagcttcagttcgagtcctccgaggaggctgacaagggcaactcccactccaagaagatgctgaaggccctcctctccgagggcgagtccatctgggagatcaccgagaagatcctcaactccttcgagtacacctccaggttcactaagaccaagaccctctaccagttcctcttcctcgccaccttcatcaactgcggcaggttctcagacatcaagaacgtggaccccaagtccttcaagctcgtgcagaacaagtacctaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtgtcatcatccagtgcctcgtgaccgagaccaagacctccgtgtccaggcacatctacttcttctccgctcgcggcaggatcgaccccctcgtgtacctcgacgagttcctcaggaactcagagcccgtgctcaagagggtgaacaggaccggcaactcctcctccaacaagcaggagtaccagctcctcaaggacaacctcgtgaggtcctacaacaaggccctcaagaagaacgccccctactccatcttcgccatcaagaacggccccaagtcccacatcggtaggcacctcatgacctccttcctctcaatgaagggcctcaccgagctcaccaacgtggtgggcaactggtccgacaagagggcctccgccgtggccaggaccacctacacccaccagatcaccgccatccccgaccactacttcgccctcgtgtcaaggtactacgcctacgaccccatctccaaggagatgatcgccctcaaggacgagactaaccccatcgaggagtggcagcacatcgagcagctcaagggctccgccgagggctccatcaggtaccccgcctggaacggcatcatctcccaggaggtgctcgactacctctcctcctacatcaacaggaggatctgagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggtcacaccggttaaaaccaaaatccagtggcgagctctcgagtcgatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgggttaccgaattcgcctagaaggccatttaaatcctgaggatctggtcttcctaaggacccgggatatcggaccgattaaactttaattcggtccgaagcttcgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctgctagcgaagttcctattccgaagttcctattctctagaaagtataggaacttcagatcctagaggatcgatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatgcatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggccagcttggtcacccggtccgggcctagaaggccgatctcccgggcacccagctttcttgtacaaagtggccgttaacggatcggccagaatggcccggaccgggttacccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccaccggtcgccaccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgacgaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagcggcccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgaagctgggcaactttattatacaaagttgatagatcgagcgactaattaactagctgtcccacggcctaactagcacttaatcccctagcctaacctaagagcgctaatctaggctagtggtcacttagggctttaaggctagcgtatacgaagttcctattccgaagttcctattctccagaaagtataggaacttctgtacacctgagcctaactaactaggacgtcccgaggtccgattccgggctaattaacacctagctcgccactcgactaattagggactaagcctagcgcttagccgttaaaacctagcacaccctaagcacccttagttaggttcccctcttaattaagccctagtgagcccctaagttaaggggacgctaagagccccctaacctagtattcggctagaggcgaactaggctaaacacctaagcgcacctctttaagctagatcgctagggggctaggctagagcttcgctagattagtctaagggcagctaactaactaggtttaaactacattaaaaacgtccgcaatgtgttattaagttgtctaagcgtcaatttgtttacaccacaatatatcctgcca

SEQ ID NO: 91 - DNA, 14566 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagattagcgacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtccctggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgcgatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtagttatgtacaggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 92 - DNA, 13820 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttacgttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagattagcgacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtccctggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgcgatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtagttatgtacaggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 93 - DNA, 15002 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattgctaactaactagaattcctcgaggcggccgcgtgctaggttttcatttttttgaatttcttttcttttctagaaaacatataaataactatatttaactatttcaaaaatataataaattcactaaaaatatttacaaataaaattactagatatatatttttagaccaaagtctattatataaattaattggatttcgcaataaagaaatactacaaataaaatcctcaacaatcattagcaaacaaaatcatgctttcaaaaaaatgaatagatcaaacacttaattaaaaaataatttattcaaaagattatatatatacatatatatatatgacattattttctttattttaaaattgttttctctctactagttttagcaactaatgtttaatttcttttaagttttaattgatggatttgaggtgttacatattctatatatcggggagaatgcatgtaacttgtattatccattggtaggtcctcaatttgcttccaccatttgattcacctaaaaggccaccacccaccagtagccgagcctcagctttttctggagctggcaagcagccctcatggacctcatgtgatttatattcacccaaaaaaagtttttcagaaaagaatttgtatatattttcgtcaactctattttatctctcttgccattaacatcgtgtcactggatctaatacgtgatacgttgtgttaaaacattgcgagaacttattttttttcttcttttgtgatatgggaggcaaatctgtcttttttttttgtcatggggttttgatttatatggaggggaagtgaaatgaaaccttttttttttgccaccgatgccttctattcaatctggtgcctcttgttcgccgcggggctgcagcctgcaggtagtcaggcatcgccggcagttccatttccatgacaacgcgtcgtccgcccggggtactggcctgattcgggcacccagaaagtttggcctttcttttgacagttgaaacaagttttccaaattttttttggccatgtattactataaacaaggtttcgccatttgcctatgtttattaggaagttacatccggtttgctgctgccaccattttgtcagcccgtcacattcatatcttttatatggctattgctcttcctttttgtaaagccgaatgaatccgcgcgcgacatggcactttgccgatagctgagcaccctccacgtcagcgcgatccggcgcgccagagccaaacgagcagattctcccgcgccgcgtggcacgagccggccgcgcccgctatcccctcgcggataaagccggacccactccggcgcgcgcgcaccacgagatcccttaaactgccgggcatcacccaccagcccaccgccaccacacagctcccacgctcaccgacgccagatcttgtgcgcgcgccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 94 - DNA, 14446 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattgctaactaactagaattcctcgaggcggccgcgtggtaaaagttggttcggcggtggtaaaaggaacgtgtgcgcctaatagcgaggtaaattaggacaactatttccgcactaatctatgacttctattttttgcttaaataaaatctatgcaaatattcaagcatccaaagagttgtaactaaggttttattcaagtgttgatatatgtattgtaaaaggtcttttgtaacctagatcaccgattgttttctgagcatttagatgtctagagctatgttattaaagtctcaactcacttattatgtttgtcagctcctacatttgagaaatgacccgttagagtggagtcaacaacattggcattcaaaccccagagtggcgattacgatttatgtgtagctgtgcgcctgtgccttaagtcttactctctccgtttctttttatttgtcgctggatagcgcaattttttacactatccagcgacaaataaaaagaaacggagggagtaacaatctgtaacatgctgctaacatttgggtggctttgcgttctgcttgttgggcccggctctgaaatgagcagtctagaagccaacggcccaacacagagcagctaattcgggcctccacgctacggctatggcttctcagttctcatctccaactacgcaccagatgccaggtggcgataagaccttatcctgcgcggctacttggcgcgagggcggccatccacgtcagacgagcgcgctgacctggcgcccctccagctcatcctatctacatatcagtgtccctctccctggcccagccgctcctaccatcagaatcagaccaccacacgcccgaggcccgactgcaagatcttgagcccaagacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 95 - DNA, 15326 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattgctaactaactagaattcctcgaggcggccgctatttgtttgttttgaacaaaaattgagagatttgtttttgagggtcggacacatacgagttttgggaaaccgtcggtggttcctgcctgtgcacacagaggtagctagctaggttggggacgggatgcatgtatgtaatacgtggcggagcttccgatcgagacagcgacatgtgggctcccatacttgctggacaacttaatcgctaccactgctgcaacttcaatttgtgaatgtgcatgtaacctcctgcactgtactgatatctctgtttctggttgcggccgggaggaattaacgaagactactggaaggattcatggatgatggacgatccatatataattgacgtcttaatgcaggaagagtatgtgtttattgtgcgataagcactcggttccaactgcaaactacctcacactgacacactagtgagagagagtgaatacgcctccaacttcatcagatgagagccacgtacgtccgtccctgccgactgccgccatcaccctgcctgctaagtcgtgttaggcggctgctatttaagggcgtgtttaaatgtctttaaaattctaaatgtttataagatttctcgtcgcatcgaatctttagacgcatgtacgaaacataaaatatatataaataaaaaaaaaataattaactacatagtttgtatatgtaaatcgcgagataaagtacttgttgagtctagttagtctataattaaatatttattgctaaatataaacgaaagtgttatagtataacataccctaataagttgctattgctgctgcaaatcaattcactctgcctcgatcatgccctcatcaactaaccgctgtagtattatctgtatctatctgcctcctgctcccaacacccaaccacctcctgcccagcaattaacttcgacggatggcgacgataccgtccgtcgtccttggaagatgatgttggaacatccaccatattcattcattcatatgcatgcatccaccattccaccgactgcctgcctgaaactgcatgcaatgcaacaacaccgtgcatgcatgcacatctgtcatcagcaatgacaagctactgtagctagctcccagatcagatcagatcagatcgatcgcaagcctgcctatttaaggagccacactccatctcactctcctcaccagcggctagcacttgctcacttgcattccaaagctagtacaagcaagtctcagacacccccagatcttcgacgccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 96 - DNA, 15665 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattgctaactaactagaattcctcgaggcggccgctacgaagagagaggggcggagtttcattaagaatggctttatgtacaacacaatgataatggtctcataaacacatgatcatacgggtgaaacgacgacaaaattagtaaatctgtggaatgatcttatgcacaacaacagcaacatgaccttaatccaataatagtgccatctttatgtttgttctagaagagggccaagaggttggtggcacaggggaatgcatgtgccaagcagctatgactctccacggtgggacgccgacccacttgcaaagttgcaagccttgcgtgcccgctctagcaagtgtccgcgaataaaagttaagtaggccatgaatacatagtactcctacggtgtataggagaccgctatttgatgcactcgtaggtacacgtgtcacgattagcacttggcaggacattgatgcaggacacgtgtcacctatatgcgaaggtgtcctggaccttcacgactttttccttgatcccacgaagcgaaaccggaccttctctgctctgtccaaacatcatttcctaccatcacacttaagtaaacgtcgcggatctcctttgctctgtccaaacattatttcctacaatcacgcttaagtaaacgttgcttacctttggtgacggttcagcgagggtggcatttagtatcccgattcagatccccgacgcagtccgagaccgttcttctttttttttcttatggagcatgcagatacatgcatgtagatgcatggacttggacagatgtcaagtgtgtacgagttgcaccgcttccctcactcgtactcagcggcttgtacaagcatgtagcggtgtgtcgatccacaccacagtcgcgacgtccggcccatgcagttgtccatcgctagcagctcgatggctgcagctggagggtctgggtggacaaacgagtttcggcaaccgtcggtgcttcctgcttgtgcatctgtctgctgtcactatgctgggtaaattcatcacttaatcagtttaccaacggctaacctcctggaagagtacgtgtctttaatttgtttctggttgcagccatgcattaactattgtgggaagattacagctggaaggatcgatccgtgtaaacgaatggacggatggattggtatgatgtttaaacgtacaattatcatcgataagcactcgcatccaccccccaaaccctcgatcactgacactgaatgaattgaatgcgtgctgcctcaactgcacaccgaccatcatctgctggcccaactcccaactacctcctgccggtcccttaactcccatccggtcgatcgagaccgacaccaacgacagggttccaccgacgactgcaacacaccttgggcatcgccatgcatgcacccatcagctagcagctccccgtctccgtcctcgtcagtcatcgctcacaaaccacacagagagctaggtcgatcgagaccctatttaaagaccaacattccctcctcaccagcaaagcaaagcacattcttcccaagcagcttgtagagcacatccgatccatcgaccacagcgcagctagcagctagcacaggaagatctacatcaccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 97 - DNA, 15142 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattgctaactaactagaattcctcgaggcggccgcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatatataggctctattattattattattaattaaactcgctctaaggaggaaagtgggaggaagggacgaggacgaagactactggaagcatcgtccttggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatatatactgtacatgcctccctccaacacccaaccacctcctgctcggctcttaataacttggacacggatcgatgccatccaaggaagaacacgacgacgacgacggaacatccaccatgcaagctagcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcagagatctccctcctcaaggaccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 98 - DNA, 15211 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattgctaactaactagaattcctcgaggcggccgcgaacaccaaggagaggattcgatgacgagtttgaggacgccattgctaggatgattaaccctaggctctggttccatgtagaaatcagaggcgcgatggaaataggtggaacgtcggtctccgctccagagatcacgacggcttcgtgtttgatatttctggtggcacaaaaacaaggcgcgagttacatatatatagatgagtatcgccagctttagttctattctaggaaaggataagttttacatggttacaattgatctatttctattaactgcctatagaacttagccggcaatatctcaaccatatttggaatacaacacatatatgttaacaatcagtctagcagctaggttgctgtgtggattcgtgaagcggcaaattcttggatggctgcaggtgcccgacatctttcgagcctccttgcaaattgctagtttttttcttgtttttcctctttgacttggtccgagtgtgctatgcagttgctgtgagagtgcaccttctgcttagtcgcatgatacaaggaactgttgattctaaaaaaaactttattttaatgtaaaggagagagaatttaatatcagttttttttcgatatagactttcatgtgattttgcatcgcccgatacatcagtgtgtttgtttggctttagtccatagcggcttctataacgttttgcctcgatagattacagctagctgcagcagttttaaaagccgtctttaatcggaagccaacatctcgacatatagagcgttcgataggatgcttacttattctagtctattaaatttcccaccgctgctaattaatgctaatgaattaactctctctgcctatccctcgacatgcactaatgtaggagtatatcccaacgcccaaccacctcctaataacttcgacggatggcagctaccgtccttggaagatggtgacggaatgtccagcattccaccgactgccagaaactgcacgcacatctgtcatcagcaatcgctagcctatttaatgagcaacattccattgcaatctcctcaggccacttacctgcagtcaccactcccaagccagtacccacagtcctacgagcagtcgcacgcaagtgtcaagagatctaacggtcgccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 99 - DNA, 15875 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattgctaactaactagaattcctcgaggcggccgcggttggcaggtagatcgatacgagaatgacatgaacataatggatcgtcggcttcaatttggaagccacctgctggcgaccgacagccgtcccggccgggagggataacctacgtcaacgataaataaatactcctactaactggagtagctagcagcttggtcttgtgaaaaagaaagataaaattctactactccatagtgtacgtggtcttatctagagcttaattggattgcaaaatagcatacagctgattgattaaaaactacgttaaacttaggaggtgtttagaaattaggactaaatttagtccctctcacaaaaatataagtccctttagtccactttagtccctccaaccaaacaccaccttcaaacaccaccttagtaactgaaaattcttagatttaattgatcgatctgctgagagctttgcattgtggagcacatgccaggccagctagtacattcttgtgataagaaacatgaagtttcggtttaacctcttaaatacatgcatgcatggttgatacaatacacgtcctgaacatgaataaatactattaaatacgttatccgaattttatcatatagtaatatatttggattagtttcttaatatgacttttattcttttatcccaattatatatcaatctcttgtgtactaaaatgtgatgtgctattgagatatttcactgtgtttgtaccaactcctgaaaatactcatcatatcgtcgttgttggttggcattcatagtttattttgtagcagctgagcaattttaattagtctttttagcttgtaagattcttatatttcttagcaatagccgagcgcattattgggctatagtgtaaccaggtgaagcgtacgcgtgtgcataagttgtccttgtggttgaaagaagaatactggaaggatcgttggatgttactgctgatatgatggacacttggttccaaacatcatgaatgcgctcaactacttgcatgttccaaatgtacaacatgcatgctagctgctacaaacgactagctccgttaggccgctgctaatcattttctcatcactaatactaacactgtgtgactagctagctaaaccagccctaacaaccaaccaccctgattcaattgaattgaattgaataacattagacgcaccgacgactaagaacggtgcctaaacactagcactccaaggttaattacactatgcgtacaccaattaaaaaatgtcacgaaacattctataaacaaattagatatttactcctaatagtattatacatatgtgcaaagtctcatattcaaattcaatatattttagctgtaacaaaaagtgaaaaaaacccgaattttagctgtaacaaaaagtgaaaaaaaacccgacagttttaagggtaaaaatatcaggattttgtcttttttatggctaaaatataatgaaattgaagataagatttcacatgtaggtgtaaaactattggaagtatgtgtccaattttttctaaaattttttatgacatttgctaattgatatgtatagtgtgtacataagtaaaggttgtgtgtataggatatgttctctaattataggtggactatatattccacgtagtaactacatttgacttggtcgatgcatcggcacagatgaaatcatagctatttaaagccccctacattcccgggaaatctcatcgatcgatctcacctgcagcagcaaacgagcaccacacaccagcagcagcagcaaagtcgatagatcttcagcacacacgaccaagatcgccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 100 - DNA, 14940 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggagacgccacagcagcaatccgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacgcccgcgtcccggcgccgcccgcgataccgatgccgatggcgccgccgccgcccgctgcatgcaacgacaacggcggcgcgcgtgtgatctacaggaacccattctacgtggctgcgccgcaggcgccccctgcaaatgccgcctactactacccacagccacagcagcagcagcagcagcaggtgacagtcatgtaccagtacccgagaatggaggtagccggccaggacaagatgatgaccagggccgcggcgcaccagcagcagcagcacaacggcgccgggcaacaaccgggacgcgccggccaccccagccgcgagacgctccagctgttcccgctccagcccaccttcgtgctgcggcacgacaaggggcgcgccgccaacggcagtaataacgactccctgacgtcgacgtcgacggcgactgcgacagcgacagcgacagcgacagcgtccgcttccatctccgaggactcggatggcctggagagcggcagctccggcaagggcgtcgaggaggcgcccgcgctgccgttctatgacttcttcgggctccagtcctccggaggccgctgacgtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 101 - DNA, 14718 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatgaggcttcaccatttccatgtggcttacttggataaagcggcaggctcgccgccgccgtcgtcgtcaccaccatccatctcaccagcatctcacagtcacagctcgtcgtctgctgccaccatcgtccctctggccctccagcaatactgtctacgcccgcttgcgcccaagatctccttccctgaggcgaggaagatggtcgtccttcctgagttcgctcgcgtcaggaatgcttcttcgaggctgctaaactgcacggtgcaagtgccgccgacgacgacgacggtgggtggcacgacgcggtggaacccgtcgccggaccagataagggtgctggagatgctgtaccgcggggggatgcgcacgcccaactcgttccagatcgagcagatcacggaggagctcggcaagtacggccggatcgagggcaagaacgtcttctactggttccagaaccacaaggcccgcgagcgccagaagcagaagcgagctgccctcctcaccctcagcaccaccaccactgcttccacgctgctaccaccagctgctgaaaccaaggagggagtggagacgaaaaaagaagaagcgtgtgaagatgcatcgagccgcaagcggaggtgcagggcctgggaagatgtcgtcgtccacggtggcggcgacgatgccggtacggaggtagctgacgactactacaccgacgacgatgtgaccctggagctcttcccgctgcgtcctgatcaggggaaataacgtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 102 - DNA, 14673 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggacacggaggcgccgagcgggcgggtgggcgtcaagtgcgggcggtggaacccgacgccggagcaggtgaaggtcctgacggagctcttccgcgcggggctgcggacgcccagcacggaccagatccagcgcatctccgcccacctcggcgccttcggcaaggtggagagcaagaacgtcttctactggttccagaaccacaaggcccgcgagcgccaccaccacaagaagaagaagcgccgccgacgcggcgcggcaatggcatcgtcgtcctcccccgacagcggcagcggcagcgggagcagcgaggaagacggccgtgttgccgccgccgccgacgccgacctcgtgctgcaaccatcgccgggaagaagcaaaagcaaacgggaggccagaagaagctacggcggcggccaccatcgccggctcgttacatgtaagcagctagcgcacacacatcgctacgtcagggacgttgtggagcagcaggaggaggacacgtgggagcggccgacgagggaggcggtggagactctggagctcttccccctcaagtcctacgtcgacctcgaggcggagaaggtccggcggtacgtcgtcagggccggcgccagcgagcagtgcagggacttctccttcttcgacgtgtccggcggtcgcgatccgccgcttcttgagcttaggctctgcagcttcggtccctagcgtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 103 - DNA, 14949 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgagctcggtacggccagaatggcccggaccgggttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcccatggcggccaatgtgggcgcgggcaggagtgccgtcggcggcggcggtggtggtggagcgggtggcactggcactgctgctgccagcggcagcgtggcgacgacagcggtgtgccgccccatcggctcgcggtggacgccgacgcccgagcagatcaggatactcaaggagttctactacggctgcggcatccggtcgcccaactcggagcagatccagcgcatcaccgccatgctgcgccagcacggcaagatcgagggcaagaacgtcttctactggttccagaaccacaaggcccgcgaacgccagaagcgccgcctcaccaacctcgacgtcaacgtgcccaccgccgcagccgccggcgcggccgacgccagcacccacctaggcgtcctctcgctgtcgtcgccttcaggcgcggcgcctccctcgcccaccctcggcttctacgccggcaatggcggcgccggctcgaccgtgctgctggacacgagttccgactgcgctgcgatggccactgagacatgcttcctgcaggactacatgggcgtgatgggcacgggcagcgcggccgccgcgtcgccgtgggcatgcttctcgtcgtcgaacactatggcggcggccgcggcacgggcaccgacggtgacgcgggcgcccgagacgctccctctcttcccgacgggcggcgacgacagccagccccggcggccgcggcacggagtcccagttccagttgcagcaggcgaggccatccgcggcggcagcagcagcagcaggtacctgccgttctggggtgccgcgcccacaactgccagtgccacttccattggcatccagcagcaacaccagctgctgcagctgcaagagcagtacagcttttacagcaacgccatgcccggcaccggcagccaagatgcatcagcagcatccctggagctcagcctcagctcctggtgctccccttaccctgcagggaccatgtgacgtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 104 - DNA, 14894 bp, artificial sequence
  Synthetic construct
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaaggttaccagagctggtcacctttgtccaccaacttattaagtatctagttgaagacacgttcttcttcacgtaagaagacactcagtagtcttcggccagaatggcctcttgattcagcgggcctagaaggccggatcactgactagctaatttaaatcctgaggatctggtcttcctaaggacccgggatatcggaccgattaaactttaattcggtccgataacttcgtatagcatacattatacgaagttatatgcatacgcgtcttaagtcgatcgctatcaactttgtatagaaaagttgggccgaattcgagctcggtacggccagaatggcccggaccgggttaccgcggccgcgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcgctccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtggatccgccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagatcgaataacttcgtatagcatacattatacgaagttatacctggtggcgccgctaggggctgcaggaattcgatatcaagcttatcgataccgtcgacctcgagggggggcccggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgcctgcagagttaacggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 105 - DNA, 14504 bp, artificial sequence
  Synthetic construct
caaacaaacatacacagcgatttattcacacgaacccgaattacaacggtatatatcctgtcagccaacaccaaaacatcaaaaaaatcgggatcaggatcaggatctgcggccgcatcctgcaggtttaaacggccggccttcactagctagctgctaagctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaatcgagctagttaccctatgaggtgacatgaagcgctcacggttactatgacggttagcttcacgactgttggtggcagtagcgtacgacttagctatagttccggacttacctaactgactagagtcacacttagctgaccctagtcacttaggcgcgccgtcgacggatccgtaccatcaactttgtataataaagttgcccgcggccgccggtacctctgttaatgaacgtaaggagcttctggatgacggctgggacttctttgacaaagagacagagctctaagtgtcttcttttcagtagattatcggtgctagaataaaagagatatgaagggattctgggttctgctctatgtagagtaaagcttggatctttgatctaatctaccgttagtataaaacatctattgagctctcttttatttttcttctcagtgtatagtttgcttattgtttttttggtgtttttttccacctctttgtggtactgacataaacaaagactatcgttttgtcatagaattttgagattttgaagaaaagttggataatttagtatactttttaactgactttataaaacgaattagcttcaattagagcttcacaattctcggattttactgaatgacaagttaacaatttaagctagaaaaaaatatgctctaagcctggacatgttgttagtcatggccagcgtatgtgtacattaggtaaatgaaaacaaaaacaaaaactttgaaggtttctgttaagaaaggaactaatttagcaataagagacatgatattacaagctcaacactgtcgctatatctaccagaagccaacaaatcttccagtgcgtaccattggagccacttttcaggctcattagacaaaagtagcacatataatgtaaagacgaaacgatgataaagagactcacaaggacataatttcaatacagaagaagtttgatgtcattactcattagaaagaaaggtataacacaggaacggaaacatagttgaacaattattcatcaggggctttacaaggccccaaaacacaaaccaccaaagttttaaatgaaacgagacatgaacttcttctgattcataacagagataagtttcctaggtcccaatctagttcagtctcaattccagggaagcgcatggtctgacctcggactgtccatacttccagatagcgccagatcctccgttgatgtggtcctcaccgtgcattggaaagagagggagagtccttctgtgttccaagtaagcatcacctccgcattcctcttcttcttggtgtccctccaagccgaagagaggtttagccctatcgaagaagttgtagggagcggaggagtagtggtgatccatgtttgcccatccgcctccaacgttgttgtagttcatggagcaatcttgctccatagagccgtacacgtgggaagacatgtagccgttggaggcgttgacaactccacattcggttccagaggaggcatggttgagattcccgttgttgaaagaggggtagggcttgttgtggtggtagaggtgatggtcctggttcaacttcacgttgacggagtttgcgggtctttgcataggaactccgtggtggtgatgaagcaaaggatggtagtggtcgttggcggccatcataacagaattgggtgatgaggaaggagtggtcatgttagtcccgttgaaacgcttcttctgcctctcacgagccttgtggttctggaaccagtagaagacgttcttaccctcgatcttaccgaattgacgcaggcgagcggtgatcttctgaatctgatcagcagtaggggagcggatggcattgttgtagtacaactccttcaggatcttgatctgctcagtggtaggtgtccatctggtggaggtctgtctgcaagtgtaccctccggaaccggacttgttgttgttgttgttcccggactcttgatcggcctgatggtggtgatgttggtgctgaggaggctccatggactcattagctagtaatagtattttctttgcttctgctatgtaatagtatttcctttcctttctgcccggccttatatatatatatatatcataccaccgacagaagaagaatatctgcatcctcatttaatatttattgcaacttccaagccgtgaacccgccggatatcctgccacttcttttttctgactcactgcatggtaacatgtggctcacacctgtccacatccaccagtaaaactccacccacaaatattactctctctggactcaaccattagacaaaaaattagttaatattatttaattttgataatttcaataaaaagttaatttattccttaaaatatcatctatattgattatataagaaaaaaaaataagattattaaaaataaaactcaattaaacgaatgatgttttgaaaatacatcattaagtaggtgataaagtaggtgatagttaattaaaatttgtttatattttaatctaacacaattgattttttttttattttttttacatttgaggtctaaagggagtattatgattaaagatttttttgtgtaattatgttagaattatctatcaattttattcataattaattttaacaaaactttatttaaaaaatttgaattcaatactatttggactaactacttgttggtagactctttctttttacacattttttttcatctctccaaataattttacaaatatgtaaaaagaaaacataattttataaataaaaaatgaaacaaaaattaatttctaaactgtatttaatacattaaatgctttttcctgaaatgcattaaatacttatttaatacattaaataagtttctttaatgcattaattttcaaaaattaatttaatacatttaagtaacttatttccgtaattagtaacagtcaaaataataagtgaggtcctttttattgattttttttattctagtttctatttttcaaatttttgtttttttattttatttcagaaaccagaacacatgctgaattaacaataactataatatgcatatataaaataatattctatatatatatatatttaaatataccataaatactatttaatatataaatattacgattataacaaatttaatactctctattgtcttaaatgtaagaaaaaagatcagccagagataagtggaatattccaattattttgtgagaaaatcatcatgcccaccagacaatagtagtagcgaaaagcaagacattctaacacataaattgggtgtttgataattctgtgtttttaagttagacttggtagagaggtgcgtattgaagggttccctcgctgcacgttgtaaaacaattatatccattctttatcaatatatatatatatatattttgtgtacaagctttaaacttcaaaacttactattcgaactctaccacttgcctgaccttatacaaagaagaagaattcagggtccttggtcaaacccacactagtttctccgtgtgtgtgtgtgtatacggattgtttgattaacgatagaattgtcatttacaagattacatgacaaaaaatcaactacttaacagttaaacaccacggagacattaattatctgacaggcaccatatgaacaatcgaaatgacaagtatcataaacattttttttagaaattcatgaactcctgtttaaacgaaagcaatataaactgtactggggtgaatatgccataaaaacagtaaactctaaaagatgcttttattgaaaaataacttttaaaatgttgtttatacgtaaaggtttttggcttaaaaatgggtttaactcctataaaatgagcgaaaattgattttgtaaacttttctttggaatgaatccctgatcattatttttgatccctattatcatggggaaacttgtatgtttaatggaaggttaagtaacccttccaatttctaattgatattcaatagtggttttggggctatgtcccgggccattctggcccactttgtacaagaaagctgggtctagatatctcgagtgcggccgcgaattcggtaccggatccagtcgactgaattggttccggcgccagcctgcttttttgtacaaacttgaagcttcggccggggccgcattcgcaaaacacacctagactagatttgttttgctaacccaattcgagctcggtacctcgcgaatgcatctagatatcggatcccggggttaaccttcagcttagaaatgatgtgttttctacacttttctcttcttttttttcttttcatctcacatgaatcaaaaagagaaagcttaattacattaaaggttgatgtgatatttactttctaaatatttgctagaagaaattataatgataacattaaattaagttatagtcatttctatttcggttgtctcccactttctgctatgcttttacaacaacagttcaagatttggaatcgttttctttctccaccaatcgtagtaatacttctttttgtgtttgttgaaattttgcaagattctctcttcctctggttaatacacataacttacttggtaagcttggctgcattttcttttcaagcttttaatcaaagactcactagaaattgcaaaggcaaacataaaattatgtgatcaaactcctactgtgagtttttggttacaaacaaaagttaaaaacaaaagcttgatatttaaaagataaactcaacacatatgcatttgactggcgcacagaagacaattcaagacttgggaaaacagtgagccatcaaaatcgtcagataattcagggaatatattgaatgtggagatgtggtaatcacactattgcacacaaagagtggcaaacaagcggcgcccttggtttggtatagtaagagacaattgttttggactgtttgtgttgccatattcacaaaaatactattgagctatgtatgttaaacattatggtcaatgagtagtagtgaacattcaagtttttttttttttccacttcaagtttttcatcttattattatttttcgttgtgatgcagtagtacggcccatcttcaccagtagtatatcaaagccgaaacagatgacaaattgtttaacatgcacttggattattattgagagttgaaatacaaaggcccgttacaagcccaaacgaaggtacataaaagaaaagcagaaaatgaaaacgaaatcgatagggataagtttttccaactgacggaaacacaaactacaccaggtgaaatagatcacctcccaagtgcatgagacacgaaccaaccacttatcatcagatcacaaaagagctcaaagatctagcgatcgcctaattcagtttgtggccaagctttgatggcaagtcgcaatatctagcgacggccacctcgtgctgctccacataagtctccttgtcggcctcttttatgcgctcgagtctatggtccacgtaatacacgccgggcattttcaagtttttggcaggctttttggagcggtaggtggtcttgaagttacagatgagatggcctccgccgacaagcttcaaggccatgtcggatctaccttcaagaccaccgtcggctgggtaaagcatttcagtattggcttcccagccgagagtcttcttctgcatcacgggaccgtttgatgggaagttcacgccgcggatcttgacgttgtagatcaagcagccgtcttgaagactagtgtcttgggtggcggtcaagactcctccgtcttcgtaggtggtcactctctcccaggtgaatccctctgggaatgactgtttgaagaagtctgggatgccctgggtgtggttgatgaaggttctactcccgtacatgaaggaggtggctagtatgtcgaaggcgaatgggagtggacctccttcgaccaccttgattctcatagtctgggttccctcatagggcttgccctcaccctcagaggtacacttgaagtggtgattattcacggtgccctccatgtataacttcatgtgcatgttctctttaatgagctcctcccccttggacaccatggctgtagagtcaacaatcacaagataaatcagaatcaaaatccatcacgtaatttcaagaagcaatttcgtgaaaaaaaatcctaatctatggccacagaatcaacaaataaggtagttgctaaaggacctgagcaatatctcttgaaataccatacagaatcaacgaataaggcttttatcaacggatctgaacaatttcttgaaaaacgactgaagtatcaacaaataaggctgttgtttaacggatctgaagtagttcatgaaaaaaaccttaatctacgactacagaatcaacaattaaggcttgttgtaaacggatctgaaaatctttatgaaaaaaactctaattagacctaatttacggttataaaatcatcaattaaggacgttcttgcattaataaaagctgaatcttctgattatgaaaatttataatcgatgaaacgatagaaaacacaatcaaatcaacatcatgctgatgtagaacaaacaataaagaagaagaaaaaaaaacggaagaaatctacgaaccttgaaaggagaggtagggaactgcgcaaagagaatgaactaatttgattgcaattgaagtgcgattagggtcgaggggtgtgggggcattttatagcatatgcggtggaaccgttctccaatcatattgtgacgcgtgcccatgtatggtgtgacttggtgtttatgacacagatgatatttcggggagtccttcgtagttgacggtttcgtaatcttgacggagtcagagatgtaccttcaccgcttcacgcttggctttatccgttaccacggcgttattaaattgggcccgcacccgttgcaagttaggaccacagtgtccattacctgaacggtcggctgctaccagtattttacattattaaaatctatggaaaagctgtcacgctagatttttttttttttttttatggataagaaaagactaataggaaagctttcttactccactaaagtctttaataattattttttcaattttcaaataaaatcataatcatcccactaaattctttctcatttgtttttcactttgtaagatattcttccgtagatttttataagtaattctttaagatacatagcataataaattgtatacttttagttacagtctatataaaattagtcatttaaaaaatatagccttaatgatttttttaaaatgaagttatttttttctaatttttctttcttatttattatcgaatgattttttctactaatcgtttagggaagagttttatttttctaatgacgagatgtgttaaatgatgcaacttgaaggcgacatattttttaccaataaaataaaactaaaagatagcttgttgacaaaaacaataattgatgttaaagaaaacgtaagggcaatgggtatcatctaattgttggacaagttgtcttctaaggctaggtaagcttttgttttttattagctgaaatatttatttaattgttctataaataaattttttaaaatgatttttaatgtttttaaatattatttaaaataatttttttaaaattttaacattttagtttttaattattttttatcttacttaaattaattataatttattattttctaccattttatactttccaattaattttatcgaagcattaataccatctggtattttgtcactgcttcgtatgattgtttattaaattttagcttctttcacattggagatgctgggcggtgtgagttacagcatggtgtgaagttaaggtggtttgattatggaacccgaaggtgttggtgcaaggtggataaaattgcttgccaggagatacataaaatgatttacaaaatgaaataaagaataaataaatagtcaagttcaaatttaaatcaaggattagaattatttttccgtacatgatgtaaccgcaatcaccccctgctgaatccagatggccattctggccgaatttaagtgactagggtcaccctgctgaatccagatggccattctggccgaatttaagtgactagggtcacgtgaccctagtcacttaccggattctggccgtaccgagctcgaattcggcccaacttttctatacaaagttgaggtacgagatccgcccatccggccggccagatcctgcaggagatccaagcttggcgcgccgcggacctgaattccagcacactggcggccgttactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgaggtacaaattaattaataagtgactagggtcacgtgaccctagtcacttatgattccgatgacttcgtaggttcctagctcaagccgctcgtgtccaagcgtcacttacgattagctaatgattacggcatctaggaccgactagttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatctagctagctaagtttaaacggccggccatttacaattgaatatatcctgccattttacacctcgatatatcctgccacaaattccatgtacacagtacattaaaaacgtccgcaatgtgttattaagttgtctaagcgtcaatttgtttacaccacaatatatcctgcca

SEQ ID NO: 106 - DNA, 2000 bp, Glycine max
acatagccccaaaaccactattgaatatcaattagaaattggaagggttacttaaccttccattaaacatacaagtttccccatgataatagggatcaaaaataatgatcagggattcattccaaagaaaagtttacaaaatcaattttcgctcattttataggagttaaacccatttttaagccaaaaacctttacgtataaacaacattttaaaagttatttttcaataaaagcatcttttagagtttactgtttttatggcatattcaccccagtacagtttatattgctttcgtttaaacaggagttcatgaatttctaaaaaaaatgtttatgatacttgtcatttcgattgttcatatggtgcctgtcagataattaatgtctccgtggtgtttaactgttaagtagttgattttttgtcatgtaatcttgtaaatgacaattctatcgttaatcaaacaatccgtatacacacacacacacggagaaactagtgtgggtttgaccaaggaccctgaattcttcttctttgtataaggtcaggcaagtggtagagttcgaatagtaagttttgaagtttaaagcttgtacacaaaatatatatatatatatattgataaagaatggatataattgttttacaacgtgcagcgagggaacccttcaatacgcacctctctaccaagtctaacttaaaaacacagaattatcaaacacccaatttatgtgttagaatgtcttgcttttcgctactactattgtctggtgggcatgatgattttctcacaaaataattggaatattccacttatctctggctgatcttttttcttacatttaagacaatagagagtattaaatttgttataatcgtaatatttatatattaaatagtatttatggtatatttaaatatatatatatatagaatattattttatatatgcatattatagttattgttaattcagcatgtgttctggtttctgaaataaaataaaaaaacaaaaatttgaaaaatagaaactagaataaaaaaaatcaataaaaaggacctcacttattattttgactgttactaattacggaaataagttacttaaatgtattaaattaatttttgaaaattaatgcattaaagaaacttatttaatgtattaaataagtatttaatgcatttcaggaaaaagcatttaatgtattaaatacagtttagaaattaatttttgtttcattttttatttataaaattatgttttctttttacatatttgtaaaattatttggagagatgaaaaaaaatgtgtaaaaagaaagagtctaccaacaagtagttagtccaaatagtattgaattcaaattttttaaataaagttttgttaaaattaattatgaataaaattgatagataattctaacataattacacaaaaaaatctttaatcataatactccctttagacctcaaatgtaaaaaaaataaaaaaaaaatcaattgtgttagattaaaatataaacaaattttaattaactatcacctactttatcacctacttaatgatgtattttcaaaacatcattcgtttaattgagttttatttttaataatcttatttttttttcttatataatcaatatagatgatattttaaggaataaattaactttttattgaaattatcaaaattaaataatattaactaattttttgtctaatggttgagtccagagagagtaatatttgtgggtggagttttactggtggatgtggacaggtgtgagccacatgttaccatgcagtgagtcagaaaaaagaagtggcaggatatccggcgggttcacggcttggaagttgcaataaatattaaatgaggatgcagatattcttcttctgtcggtggtatgatatatatatatatataaggccgggcagaaaggaaaggaaatactattacatagcagaagcaaagaaaatactattactagctaatgagt

That which is claimed:

1. A method for producing a transgenic Poaceae plant, comprising:
   (a) transforming a cell of a Poaceae explant with an expression construct comprising a heterologous gene of interest; and
      (i) a nucleotide sequence encoding a WUS/WOX homeobox polypeptide; and
      (ii) a nucleotide sequence encoding a Babyboom (BBM) polypeptide or an Ovule Development Protein 2 (ODP2) polypeptide; and
   (b) allowing expression of the expression construct of (a) in each transformed cell for about 0 to about 7 days or for about 0 to about 14 days after initiation of transforming the cell, wherein a somatic embryo is formed within about 0 to about 7 days or within about 0 to about 14 days after initiation of transforming the cell in the absence of exogenous cytokinin; and
   (c) germinating the somatic embryo to form the transgenic Poaceae plant.

2. The method of claim 1, wherein germinating comprises transferring the somatic embryo to a maturation medium and forming the transgenic Poaceae plant.

3. The method of claim 1, wherein the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153.

4. The method of claim 3, wherein the nucleotide sequence encoding a site-specific recombinase is operably linked to a constitutive promoter, an inducible promoter, or a developmentally regulated promoter.

5. The method of claim 1, wherein (c) is performed in the presence of exogenous cytokinin.

6. The method of claim 1, wherein the nucleotide sequence encoding the WUS/WOX homeobox polypeptide and the nucleotide sequence encoding the BBM polypeptide or the ODP2 polypeptide is operably linked to a promoter selected from an inducible promoter, a developmentally regulated promoter, or a constitutive promoter.

7. The method of claim 4, wherein the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2);
   the inducible promoter is selected from AXIG1, DR5, XVE, GLB1, OLE, LTP2, HSP17.7, HSP26, HSP18A, or promoters activated by tetracycline, ethamethsulfuron or chlorsulfuron; and
   the developmentally regulated promoter is selected from PLTP, PLTP1, PLTP2, PLTP3, SDR, LGL, LEA-14A, or LEA-D34.

8. The method of claim 6, wherein the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2);
   the inducible promoter is selected from AXIG1, DR5, XVE, GLB1, OLE, LTP2, HSP17.7, HSP26, HSP18A, or promoters activated by tetracycline, ethamethsulfuron or chlorsulfuron; and
   the developmentally regulated promoter is selected from PLTP, PLTP1, PLTP2, PLTP3, SDR, LGL, LEA-14A, or LEA-D34.

9. A method for producing a transgenic Poaceae plant, comprising:
   (a) transforming a cell of a Poaceae explant with an expression construct comprising a heterologous gene of interest; and
      (i) a nucleotide sequence encoding a WUS/WOX homeobox polypeptide; and
      (ii) a nucleotide sequence encoding a Babyboom (BBM) polypeptide or an Ovule Development Protein 2 (ODP2) polypeptide; and
   (b) allowing expression of the expression construct of (a) in each transformed cell for about 0 to about 7 days or for about 0 to about 14 days after initiation of transforming the cell, wherein a somatic embryo is formed within about 0 to about 7 days or within about 0 to about 14 days after initiation of transforming the cell in the absence of exogenous cytokinin; and (c) germinating the somatic embryo to form the transgenic Poaceae plant;

wherein the WUS/WOX homeobox polypeptide comprises the amino acid sequence of any of SEQ ID NO: 4, 6, 8, 10, 12, 14, or 16; or wherein the WUS/WOX homeobox polypeptide is encoded by the nucleotide sequence of any of SEQ ID NO: 3, 5, 7, 9, 11, 13, or 15;

wherein the polypeptide comprising the BBM polypeptide or the ODP2 polypeptide comprises the amino acid sequence of any of SEQ ID NO: 18, 20, 63, 65, or 67; or wherein the polypeptide comprising the BBM polypeptide or the ODP2 polypeptide is encoded by the nucleotide sequence of any of SEQ ID NO: 17, 19, 21, 62, 64, 66, or 68.

10. The method of claim 9, wherein germinating comprises transferring the somatic embryo to a maturation medium and forming the transgenic Poaceae plant.

11. The method of claim 9, wherein the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153.

12. The method of claim 11, wherein the nucleotide sequence encoding a site-specific recombinase is operably linked to a constitutive promoter, an inducible promoter, or a developmentally regulated promoter.

13. The method of claim 9, wherein (c) is performed in the presence of exogenous cytokinin.

14. The method of claim 9, wherein the nucleotide sequence encoding the WUS/WOX homeobox polypeptide and the nucleotide sequence encoding a polypeptide comprising the BBM polypeptide or the ODP2 polypeptide is operably linked to an inducible promoter, a developmentally regulated promoter, or a constitutive promoter.

15. The method of claim 12, wherein the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2);
the inducible promoter is selected from AXIG1, DR5, XVE, GLB1, OLE, LTP2, HSP17.7, HSP26, HSP18A, or promoters activated by tetracycline, ethamethsulfuron or chlorsulfuron; and
the developmentally regulated promoter is selected from PLTP, PLTP1, PLTP2, PLTP3, LGL, LEA-14A, or LEA-D34.

16. The method of claim 14, wherein the constitutive promoter is selected from UBI, LLDAV, EVCV, DMMV, BSV(AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2);
the inducible promoter is selected from AXIG1, DR5, XVE, GLB1, OLE, LTP2, HSP17.7, HSP26, HSP18A, or promoters activated by tetracycline, ethamethsulfuron or chlorsulfuron; and
the developmentally regulated promoter is selected from PLTP, PLTP1, PLTP2, PLTP3, SDR, LGL, LEA-14A, or LEA-D34.

17. A method for producing a transgenic Poaceae plant comprising:

(a) transforming a cell of a Poaceae explant with an expression construct comprising a heterologous gene of interest; and (i) a nucleotide sequence encoding a WUS/WOX homeobox polypeptide; and (ii) a nucleotide sequence encoding a Babyboom (BBM) polypeptide or an Ovule Development Protein 2 (ODP2) polypeptide; and (b) allowing expression of the expression construct of (a) in each transformed cell for about 0 to about 7 days or for about 0 to about 14 days after initiation of transforming the cell, wherein a somatic embryo is formed within about 0 to about 7 days or within about 0 to about 14 days after initiation of transforming the cell in the absence of exogenous cytokinin; and (c) germinating the somatic embryo of (b) for about 14 to about 60 days to form a plantlet; and (d) allowing the plantlet of (c) to grow into a Poaceae plant.

18. The method of claim 17, wherein germinating comprises transferring the somatic embryo to a maturation medium and forming the transgenic Poaceae plant.

19. The method of claim 17, wherein the expression construct further comprises a nucleotide sequence encoding a site-specific recombinase selected from FLP, Cre, SSV1, lambda Int, phi C31 Int, HK022, R, Gin, Tn1721, CinH, ParA, Tn5053, Bxb1, TP907-1, or U153.

20. The method of claim 19, wherein the nucleotide sequence encoding a site-specific recombinase is operably linked to a constitutive promoter, an inducible promoter, or a developmentally regulated promoter.

21. The method of claim 17, wherein (c) is performed in the presence of exogenous cytokinin.

22. The method of claim 17, wherein the nucleotide sequence encoding the WUS/WOX homeobox polypeptide and the nucleotide sequence encoding a polypeptide comprising the BBM polypeptide or the ODP2 polypeptide is operably linked to an inducible promoter, a developmentally regulated promoter, or a constitutive promoter.

23. The method of claim 20, wherein the constitutive promoter is selected from UBI, LLDAV, EVCV, DMMV, BSV (AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2);
the inducible promoter is selected from AXIG1, DR5, XVE, GLB1, OLE, LTP2, HSP17.7, HSP26, HSP18A, or promoters activated by tetracycline, ethamethsulfuron or chlorsulfuron; and
the developmentally regulated promoter is selected from PLTP, PLTP1, PLTP2, PLTP3, LGL, LEA-14A, or LEA-D34.

24. The method of claim 22, wherein the constitutive promoter is selected from UBI, LLDAV, EVCV, DMMV, BSV(AY) PRO, CYMV PRO FL, UBIZM PRO, SI-UB3 PRO, SB-UBI PRO (ALT1), USB1ZM PRO, ZM-GOS2 PRO, ZM-H1B PRO (1.2 KB), IN2-2, NOS, the −135 version of 35S, or ZM-ADF PRO (ALT2);
the inducible promoter is selected from AXIG1, DR5, XVE, GLB1, OLE, LTP2, HSP17.7, HSP26, HSP18A, or promoters activated by tetracycline, ethamethsulfuron or chlorsulfuron; and
the developmentally regulated promoter is selected from PLTP, PLTP1, PLTP2, PLTP3, SDR, LGL, LEA-14A, or LEA-D34.

25. The method of claim 1, wherein the WUS/WOX homeobox polypeptide comprises the amino acid sequence of any of SEQ ID NO: 4, 6, 8, 10, 12, 14, or 16, or wherein the WUS/WOX homeobox polypeptide is encoded by the nucleotide sequence of any of SEQ ID NO: 3, 5, 7, 9, 11, 13, or 15 and wherein the BBM polypeptide or the Ovule Development Protein 2 (ODP2) polypeptide comprises the amino acid sequence of any of SEQ ID NO: 18, 20, 63, 65, or 67, or wherein the BBM polypeptide or the Ovule Development Protein 2 (ODP2) polypeptide is encoded by the nucleotide sequence of any of SEQ ID NO: 17, 19, 21, 62, 64, 66, or 68.

26. The method of claim 17, wherein the WUS/WOX homeobox polypeptide comprises the amino acid sequence of any of SEQ ID NO: 4, 6, 8, 10, 12, 14, or 16, or wherein the WUS/WOX homeobox polypeptide is encoded by the nucleotide sequence of any of SEQ ID NO: 3, 5, 7, 9, 11, 13, or 15 and wherein the BBM polypeptide or the Ovule Development Protein 2 (ODP2) polypeptide comprises the amino acid sequence of any of SEQ ID NO: 18, 20, 63, 65, or 67, or wherein the BBM polypeptide or the Ovule Development Protein 2 (ODP2) polypeptide is encoded by the nucleotide sequence of any of SEQ ID NO: 17, 19, 21, 62, 64, 66, or 68.

27. The method of claim 4, wherein the nucleotide sequence encoding the WUS/WOX homeobox polypeptide and the nucleotide sequence encoding the BBM polypeptide or the ODP2 polypeptide is excised.

28. The method of claim 12, wherein the nucleotide sequence encoding the WUS/WOX homeobox polypeptide and the nucleotide sequence encoding the BBM polypeptide or the ODP2 polypeptide is excised.

29. The method of claim 20, wherein the nucleotide sequence encoding the WUS/WOX homeobox polypeptide and the nucleotide sequence encoding the BBM polypeptide or the ODP2 polypeptide is excised.

* * * * *